United States Patent 8,012,714 (SEQUENCE DIVERSITY GENERATION IN IMMUNOGLOBULINS) - sequence listing, part 2

SEQ ID NO: 113 - DNA, 909203 bp, Homo sapiens
attcacacagttaaagtaaatttggatatggagtatgatgaggaggtgatgatttctaaattttcctgttcaagttttctacatgtctacaaacacattaaaatgtctctcttagcttcataattaaccaaaacaaagaataagcaaatacaggttttttttaaaaaaggtttaaatgtaaacacattatatgacactaagtccaaattctgatataaaatatctggaacaactatttagaaaactacaaactttaaaaaataaacctcacttcataaaataaaaagtgtgtatacactattaactagtgtattaggcctaccaagaccatgactattagtaaatcacatctaagccctatcaaaactctaagagcattgtgtgctgttagaggtaaagcattgtgtgaaatgtttgctgagaattgccatcttttaagaaggccaccaaccttatctcctgggaattttccattcaatgccattccctgaacagcccctacacatgtttgaaaccatcaactgtaacagtgtctgtgatgctgaccagatggcacacgtgggtcattcaactttttccagaatatactctgggggtacaaacaccttaaaaagttacattcacagcagtttgtaccacatagaaaccaagactccttttgggagtgagaaactacaataataaagtacaacatatcaggatcacagaaggtaggattcggatgatggatgtgtgaacagagatgatggatggtgaactacagagacaggctgggctctcaggtctctgggccacggaaggagtgtgtcctgtaaccagcacaggacacagctcagtaagaaccatatactccaaggagctcggggcttggagctgggccctgtgctcactgatggggactcagcagctgtgtcctttctggcctggcagagtcccctgagcagggacctgtgtatggtctcagcaggtgcttcctcccagggccctcccaaggcgggaagtaaaccttcctcctcctcaggctgcagtgtgagctgagctccagctccagggctcagggaggggctgggcagtcccctgatggaaacacacttgcatgagcagcccctcctctgcagagggtggggaagaaaaggatgcctggggcagtccagccccacggtgtggtggggtcaggggctgtgtccaccatggacttgactcctcccctccttgtgatcctgtctcactgtacgtgtcgggacgggcctcaaagaccagcctacatcagaaactttgactgaggcccctgagaaatgttaccctgaactctgccttagtatctggatgtgtcttttcacctgatagagttataaagattttcccagttaaaaacaaaagcaaagctctgccagactcgtgttcgtggctccaaatctgcttcagccactgagcaggagctgagagggaagagagagagaagaacacaagatccatatggggaaggatttctatgagggtgtggcagtgagagcgggtggcaagttgccaaagaggcctaagccacagaagtgggtttcatgtgggactttcggaatgagcaggagggcgatgggtggagggtgagggtcagaagattctaatcagaggtgagaacccaaagatgagttattggtcattcaagtcaaacagtgaaattaccttggcctgtgcctccagtcagtggagcagggaaggggccaggatgtgcttcctgcaggtgttactggaaaggggtcctgattcagatcccaagagagggttcttggatctcatgcaagaaataatttgggaggagtctataaagtggaaacaagtttattaagacagtaaatgaataaaggaatggctactccatagacagggcagcaccaaacactgctggtcggctatttgtatagatagtccttgatcatatgctaaataaggagtggattatttattagcttttcaggaattctttttaaaaatatagaccacataaggtaacttgtggatgttgccatagcatttctaactgtgaggacaaccagaggtcactttcctcaccgtcttggtttcagtaggttttggccggcttctttagcgtatcctgtcttatcagcagggtctttatgacctgtatcttgtgatcccagtctggttgacttcctagctcatcctgtgactaagaatgcctaacctcctggaaatgcaggccagcatgcctaagcctcatttaatcaagcccctattcaacatggagtcactctggttctaacacctctgacttagggtggctgcagagctggaggtgcagattggggcagatcagcctcctgagaaaagcacacagagccactgcggggctgtgaggtgggagagatgaactcacattggcatttgatcagtgactctccagctgtaatgagaatagaatggagaggcctgggacaggaagacaggatgtggttgctcatgccatcctggtgggaagatctaggtgagttactgtggggtaaagaggagagagcagattccttgtcactttatgctgtagaatacattggacatggagagggcttggagcttgtgtgtgagaaaagcagatctatctcggctgactcccaacaaactggctgagaatttagatggaggattattattaaataaaagaggaagactgaaatgaatattgtcatcgtatttttttacccagggttgggataggtggaaatgtgtgtgtgtgtgtgtgtgtgtgtgtgtgtgtttaaatattcactaatttttcaattcaaaaatatttactgcgtgactactaagtaataatattatacaggttttagcgttaccatggagaatcaaattgtcaaggtcacaggcatctttttgttttgtgtggatcactgtgaaagatactatgctaaattttttctgaatcatgcagatgaaagcattaaacacatacacaaacatttacgtttgtgtgtgtgttgtgtgtgtgtgtgtgtgtatgtgtaatctatctcagcatacaatgccactgaaactacacttgcggattaggtcctcggaaaaataatcgtgttaacattcacgatgcaaatagaatggtacctgacacaaagtaagtgctataaaagaatacttgaggctgggcgcggtggcttatgcctgtaatcccagcactttgggaggccgaggccggtggatcacctgaggtcaggagtttgagaccagcttgggcaacacggtgaaaccccgtctctactaaaaatacaaaaattagtcaggtgtggtgatgggtgcctgtaatgccagctactcgggaggcttaggcaggagaatcgcttgaacctgggaggcggaggttcaacaagagcaaagcccattctcaaaaacaaaaaatttgaatggttaaatcacattggactgtgagtaaagggcttagacaaggtgtctcggaacttttgggtcatcttcttgatctttccataaaactctaacccttctattcttaacctcccccattcccaatttcaccctgatgtgcacatcctacctggtgcctagtcatcccggtggcccctctctgggctgtatctagggagagtggtgaccttggtcatcttcctcaggtccaagtatccataagagaagcagacttttctctctttcataatgatggtctcttcttgaataatttccctgtgcattttcattaagggtctcaccccatcaagggtgtgatgaggacagtgatgagggtcacggagcccggcctcccacggggggatgtggggtatgatgagagagagaagcaggtgccctcaggcccatatggaggctggggagggttgttaaccctcctgccctcctggccactgggtgcaggacatgttctctctgaggctcactcacctatggccccaaccacacaaaaatctaaatggggaagaagcagaggatgacttcatgctgaggaggcccatcttgcagcgagaaatgtgctgtggtgagcacctgcagcacaaagagcctggggtgggggtggaggtgcgtgagcgctgcctctgtgtggggatggtgtgcgcaaggcagtgctgaggaccttcaagccagtcaggaatgaacctgggctctgagacagtggagggaagtgtggcctgtccctgagggtctgtgggggtttcaactgggaaaccaggccctggacccctaccctgggccctctgctctgtgctttctggggcccagcagctgggacctcccaggagcagaagaggctcctctagccccaccccacactcaactttccccaagttcaggcccagggatagcagggggaggggtgtgatttgcatgaagggtgctctgtgccctcttaggaggagaggataagagagactctgtgcagttctgctcagctgtgggcttaggaagcagagcctggggcatctccaccatggcctggacccctctcctcctccagcttctcaccctctgctcaggtgactgcctgtggaatgccaaagtgattattggggacacatgggatgacttttctcttatattttaacattgtggggtgggtagtgaacccagactcacctctctgtgcctgcctcctctgttccagggtcctgggcacagtctgcgctgacccaggaagcctcggtgtcagggaccgtgggacagaaggtcaccctctcctgtactggaaacagcaacaacgttggaagttatgctgtgggctggtaccaacagatttctcacggtgctcccaaaactgtgatgtttggaaattctctgccctcagggatccctgaccgcttctctggctcaaagtctgggaccacagcctccctgactatctcgggcctctagcctgaggacgaggctgattattactgttcaacatgggactacagcctcagtgctcacacagtgctgcaggcacatggggaaccgagacaaaaacctgcccttggcctgtcccgaggctgatcactccatacttgcctatgacaaacaaagagggtgcctgtggctgatcgtacagtttaagcaagggaggaagtgagactcagccacaggcccctgcaaagggtcagcgggccttgttcccacattgtctctatttgaaaaagtgagataaatttcacttcgtataaaatgtacaattaaattgtcttattgtgtttacagaattatgcatctatcaccataatctaattttaaaacgttttcatcaccccacaaaaaaacccccacaattagcagccacccttcaccctttctccccagccactggtcattgctaaagactttctgtaaagaacatgcatttaaagacctaagaaactcagtgatgccaaacagctaggtttttcaaatgcccaagcatgtaataatagattactgaaaccaaagataaagacacaattatgaaagcagacagaaagctttataatatatacagaaaatcaacaattcaaacaatgagaggtattttatgagtatacattgaggccaaatggcagtgttatgttcttacaaagtcaaaagaaagaaagaaagaactgttgagtcataatgctatatccaggtaaagattttttttttttaaaaaaggtaaaaaataagactttgtcagatgaagaaaacctgaaagaattcatctaaaaaaaatcaaaacaaatcaactctaagagaaaattttcaggtggaagataaatgataatggaaacattgaacccaaagaatgcaggaagaataaccaataaatatagtagtaaaagaccaaatttttagctctacagttctggaaaatatgcatatcaaaagctaagttatagcatttttgatataatttctacttatgaaaaatattatatatacatatatacacatatatacatatatatacacacacacacacacacacacacacacacacacacacacacatatatatatatacatgaaacttcaaccaaaagaaggaactgtaaggggtctacatgactgggaaaatattaggcctattattaaatctaaatagatcatgaatagttacatgtacatgttgtaatctttacagcaaccaatgtaaaactgtgcagagataccaatataaaatcaatataaaaatcaaaagagcccactaaataatactcaaataatccagaagtagcagaaacagggtggagaggaacaaaagttataaagagaaaaaggaaacttacactaaaattgtaagcttaaatccaaccatgtgaataatttcattaaatgtaaatgaactaagcacatatattaaacacagagtttgtcacactgagaaaaataaaaaacaagagacaagcatgcgattctataataaactctaaatagaagtatatacacaaaagtaaaatgataacacaaataaacacctagttaaaatggcataaagcattacttcaatgttaattgcatcattctgattttctaaattgcatattgtgttgtaagatgccacttttgaggaaaactggttgaagtgtaactaaacctttattacatattttttcaccttaatgtgtatctataattatgtttacagaaaacattaaatgaaagtaaaaggatggaaaagttttatcatgtaatcctgaattaataacacaaacatatagtgtggatatttctttgcgtttcttttttgttgttgtcgttgttttttgaaaaagtctcattctgttgcccagactggagtgcagtggcacaatctcggttcactgcaacctctgcctcccagattcaagtgattctcctgcctcagcctcctgagtagccgggatacaggcgcccgccaccacacccagctaatttttgtatttttagtagagatggggttttgccatgtgggcgaggttggtctcgaacttctgacctcaggtgatgtgttcacctcggcctcccaaagagctggaattacaggcataagccacaacgcctggcctttttttgttttgttttgtttttgagacagtgtctcactctgttgcccaggctggagtgcagtggtgcaatcatggctcactgcagcctcaaactcccaggctcaagcaatcctcccacctcagcttcacaagtagctaagcctacgggcacgcaccaccatgcctggctaattttgcttattttttgtagagacaagatctcactatgttgcccaggctggtctgtaactactgggctcaactgatcctcctgctttggcctcccaaattgctggaattacaggcataagccaccacacctggcccagtatggataattcatgggtaaaaaatgtaatacttgaaaaacaaattagatgttttcttattatttccacatagcagagtactaactgtaggacattgggatgtacttttgaataagaaatgaaggtttaaaaaaagataaaataaaacaaaataagtgcctaaaactgactggtgaggggtttacccaatgcatgagcagtagaaagaatttaattttttgcatccaggatactaaaaagtggaaagatagatttcttttttttcctgttttacttcttttgggttgctctatttgatctaattaaaaagcctattactcctatgctatgctgatggaagagaagtcttctctaacttagtcccagtgagattgcctcctctgggccaacaatgctcatctagaacttggaatttcgataaatccattctgaggtgatgagcagcagcagcaccagaaaagttgatccaggccatctaggaccctccagggaagggctcaggcctgtcaaagaggcctgatagaaactggggcctgcagtcagtcagggacattgaagctctcctgacacggtcccaccagctgggaaaacactcggggtctccctcgggtttgatcagatggcaagttccccattccctgattggcccaaagctttgacctgttggacccggggcctatcaaaggccaggtgtcctctccccattggaaacctccctaggctcaactcttctcttctcattctcctgctggcctgggagcatccaggccaaggggtgaggtggggacagccctacattaagtttttatttcaaggtagaaaatctgtccccttgattgtttgggaaactataaaaagactagggcagctcagggtctaaaatacagcttcagggagtacagagttagagtgcagaaacttcaattccatttactctctagcaatttacctaatatcaaaacatacagttatgttatgtttacaaatatgcacgcacctctattaatatgtgttcataagtacatacacatgcaccattacgtttacacatacatgcatgtaacaccaactgatgtaaaaatcattgttttatgtactcagttttcctttgagtttaccctcttttctctactttttaaaatatttatttctaatttggggagctactaactgagattatttttcatctcactgaaaaacagttttagaatttcctgtagagcagttctgctggtggcaaattccatcgggttttgtctgaaaagtagccattttctcctattttttctgtttattatatagaaagataacttatataaagtaaaattcacaggtcttaattatacagtttgatggtttttacaaatgcagatgctcatgtagccaacagtccgatccattctcacaacatctccattactgcagaatggagacattctgttccagtcaatgtaaattatcccattacacctaccaaatagaacgtgtatgagagacacctttctcctgaggacttttgcaaagtggggtggatcatgtgtcccgctcccactgaaaagggctaaatggaaaactaaagtctgaaataaaataggaggctgccctgacgaggggtcccactttgcccttggacagagaacaggccgtggtcaaggccctggtccgggcagaagcctctgtcaggacccactggcatctggtcacagacacgatggacctgggcctaggcagaagggggtgctgttggtctgctgctgagggctctgtgggtttctcagctgggaaaccaaacacttgaacttggtctccacgcagggttcactggggccagcagctgggctctctctgcacccttggagagcctcaggccaggcccagcccaggtaacccctcccagaaatgtcaccccaccactgggactgacactcaggcacacggagtgatttggttgggcagaggaagaggagcacatttgcatgaagggcccctctctctcctctgggactacagggtgggtaagaaatacctgcaactgtcagcctcagcagagctctggggagtctgcaccatggcttggaccccactcctcttcctcaccctcctcctccactgcacaggtcaggatggccctcagcaccctgacctccagctcactgataccacctcccaaacttatgccaggaatgtccttccctcttttcttgactccagccggtaatgggtgtctgtgttttcagggtctctctcccagcttgtgctgactcaatcgccctctgcctctgcctccctgggagcctcggtcaagctcacctgcactctgagcagtgggcacagcagctacgccatcgcatggcatcagcagcagccagagaagggccctcggtacttgatgaagcttaacagtgatggcagccacagcaagggggacgggatccctgatcgcttctcaggctccagctctggggctgagcgctacctcaccatctccagcctccagtctgaggatgaggctgactattactgtcagacctggggcactggcattcacacagtgacacaggcagatgaggaagtgggacagaaacctcagcctgctcagggtcttgttatatgacaagttttaaattttcaaatatgttttatatgtacacactccacttggaagcaccgtctggtttaaaatgtttctactctcaatttctcattcaagttttctgaagtctcaggaaaactaaaaacagaaacaaaaatatcatgatgactatgaaatattacctaattttccaaatatgctgaattcagtgcctgtggagctaaccattttctcttgacagaagaaaaatgagccttagaaattgtttccaaatcctgaaagagtcatcattccatgtactcaggacagatttagagagtgctgaccctgccctttgaaagatgttatttgcctcttagtgcccaaataaggaaggataattaggaatcagaagcctacctagggctcccctctctcctctcaaaattgcacttggtgtcatattgccctagaatttatgcctggtgctggcaaatatttttaaatttattttttaatcttttccttttctgcaatcaaatttcttgaggggctgagaagaagaaataggcccagagagaagcaaggcagtctgggtgcaggctctagacagcccagggagaagaaagagggagcagctccctgtgtcctggagggagccctgtccccattgggcttcctgctctgatgtcccctagtggaggctcctcagggagtccagcctcccagaactgccctataaacctcacagtgagctaagcaagtatatccaggaaggagggtctgtggagatgtgagactaaggtgtgttatggcctaaacactgcccatctccatccttcttggggatgacaaagtgaacagtggaggagacaggatacatgggtgcatctggacctcaagcagtaggctgttctgtggtctgtccctaaatcttgtgctggagaccccatacgagagccactccctgaccctgggctggagccctctaccccctgctcacaagaccagcagctgtttccttataggcccccagggagccacagaacagcatcaaccaagaccatcctcttcatgtgtcagcttttcagggagggatcgaagtcatggcccaggaaagggcttggacagcccaggggaggaggctggttggtatgaaggatgccctcctcaccctgagctgctggagggagtacaagggacttggagagcccaggctcagttgatgatcctcaggatgtagagctatgtatgggtctccactgtggtctctcccccgccttctccttcactgcacaggtggctagggctcagtgtcagggctggtgatcaaaagaccaaggtttatgcatgtgtctctgtccactgacccacctctcaccctgtgtctgtcttaatgtccagcgtcctgagcccagcctgtgctgacccagccacctgcagtgcatgcatctgtggggcaggtgggtaccagctcctgcactagaagcagcagcaatgttgggcacgggcatgtgctctggtacaaacatgcctccgagagacccagagctccacatatataaaagcagtcattgacccttaggggcataggcccaatgctgaggctccaggttggagaacatggcctctctgagcatctctggactccaggcagaggaaaaggctgatttttattctcagcttgggacacaagcaccaaggctcaggcagtacttcaggccagtggggaagtgggagaaaaagctgctgcccatccagcaatggagcttctctgtgcagcccccacttcttgggcaagtcagctgattaacgttgcttttcatttgtttagtaaaaatttagattttaaaactcactccagtgaacgcagtgtggagaatgtgtttctgtcctctcaattctaccctcacacccaacccttggcagtaacaaattgtcgtattgtctcatattaagagaaatccctcaataccaagatcaggctgtcctggaaaccaaatccataatgggtcaaaacaggaccagggtcattgtgtctgactcaggatagtcgactcccaaaggtctgtttatccacctcattcactgagaagctactatgcaccagcctcagatccagggattcaaggtacatgatgaacaagagaggaaggggccctgtcctcatggagctgacactgagtggtggaacagataaggcaatcaagtaaaaatgtcaatgcgacaatatgatgtcatcacacagtgaggagagctcagttgggggtagaggagccatcagaaggttgggcaaggaagacacaggatctgactcaagtttatgaagaaaagtccagatgcctcaaagaagatgaacaaggagacagcaagcatgaaggccacggggccagttggggtcattggagagaaaggtcaggtctagcctgtgtttgtaagaggagggactgaagcctgggtgaggagagagggctcaggaatagccttggaaagtggagggagtggatgcgaaacccctgctgagggggcctccatgagcaatgaggctgggggaggccctgagctaatcaccatgatggaaactcagacaacagcctcccagcctctttcaaagttgtcacaggacgcttttctctccaaatggcaaggggggaatcccactatgagttttatttgagatgtctcttctccatgtcctgtcctgtccctaggctaaattcccatgcgcaaacaagatactgctcagtctcaggtatcacattcacacacaaatgctccagaatgagggaatgcactctgaccaacccaccaggaatttttgcctttgagaatactagatcagatcactcacaccatctcccctgacaccatcatgttgaccagtgggttgtctgatcggtttggacagcagaatgcagatgcctgtagttgcagctggggtcagtcacatgctcatctcatggctgggagactttgggtccagacaacaggaaaaaaaggaggtttgcctacgtgatcccacaatgtgcatcactctgtcatccactcccatccttagttcatgttgggttttgtcctgtagatgctgggacctggacaggatcacaagccaggcgatttctggctcacaaagttacagctcaagctccctgatgttgctgacattcttcccacagaccaattttagacagacacactattgccatgcaggcactgacctgagatacaggtagtctcaggagagggaggaagcagatacacatccccatgatggcctccttgtcccagagtgggtaagaaaggcaaggaggccaggaagccacaggagtggccactgcccaccacctgtgcacctgtccctccctcaggtgagaagcagcctgagggtccagcacctgcaccttttcccagtgcccacacacttccaagtggggcctccttctgctcacctcccaaagctactgctttccgggacatctgtgtcattgctgagagtctacttttcatggggcccttgtcccagtggtctgggatcagtgtcagcctgtttaattcagcactgtctctgtcctttcaggacaccaatctagctattaaagctctaattgaattctcctttttttgccctgaaactttagactctccttctcagtgtctctctagaatattttgtctctatccaataagatcaagttatgtcttcaggcctacagccacttctttccccaaattctgcaccttcttttaagttcttattccctcttatggcttattttccactaactagctaatgatgccaaaacatttatctattttacctccttcaggaataaaaaagaaaagcatttatcaatagcccattgtcacaaagaaaggaacagaggagagatatcttctagaaaaatacaggtgaacaaggaaaaagttttaattcctcataggaactactccatgatccaagaaaataaattccagagattcaagagttcactccttagaaacaacagtgtaaatacaaggtagtaaattttcttggttttctcaatgaataacctcaaaagggttagagtatgattataataaaaagattatacattactttcaaaaatgtaagatgaacatgtcaaaaattttaatcgactcatatttctgaaaagaccagtaaaatggtgaataattttaaagaacattttaaaacacacagagtttctattccacgagggcaggacctgtgaggataatttcctgtgttagagaaacactgtcctaaacaacaatagtagaactctctaagctctgaatttatcttctcctgtaagaaaaaatctacaaagtgacaggatccaatttatataaaatatctagcaaagattttggacattcccatctcacacctcctctccaggctctcctcaagtgaaatctactctccttctgcccgtgttctcacctttctgcacgcttccgcctgctgacacatggcttctcctgctttcctttccagtagccctaacagatcaggccctgccagtaagtaagctcctggcctgagggaaccacatcgcatgttactggatttctgaggcacttgccctgccagggtctctctttctgaatcacaatccctgtattcctgggaattctcttctcctggattctgttattcagctctgtgtttctccctccatatctactttgtgaatttctctacatcttcacctgaatcccaggaagcctaaggacatgctgatgcttcctcagttctcatgtcacaccctgttccctcctcctctatgatcccaccaggtcatcctgcatcagaaccctgagtgcggcagaggcttctctggcctccttacccccagtggcagaagggaggaagggaggtcccctgtggcctcccatccttgtgctcccattagggtcagcatgaagcaggaatgaggctgtctatatcatcatggcattcccaacactaaactctgtgcccaggagaaggtaggcactcaataactatttgacaattgaagaactgcctctcaccacactggccacattgtactggactcaggatggggctgaactggaagagtcagctgtgaacctgctcttgtctctgccctcagcctgagagctgaaggggaacctaacagggagagcacccatgggcagggaaggtacattagtagcctcatcctgtttgtgaggctctgctcagccttgggaatccctgtttattcaaggcagagaagaaggaaaacaattaaccaggcctggccaacaggcagcatctacaaggcgatgagttgagggccagatggtcagagttggttctggcatctctcaggcgcctctctccatgttgcccttttttgcgatccaggggtgaggtttcaccccactgagcccccacccatctagatgggctctgctgagagaaaaacccattttctagatgagcccactgaggctcaaggggcacatgtacttggtgatgcaccttcttcctttagagactggtcagcctagaacaccccctctcgagtggccttctggtccctcatctgcccagccccacccagatctccatgaacctgagctgtgtgagagaagagggaagagtaggaggaagggaggagtccaggccatggtgtggatgttgcaggaacccctgggtcttcaaactgaggctggacaccgcaatgttctttttatctccctcaaattttttggtaaaatgtcagtgcttgtctggtccattattcaaacctgattctttttaccaccatcataggcatacatttctgagtcttcatcccagagaacagctcctctctaaaggggaggtgtagggtggctgtgagttctgagtttgcccctggggaggaagcacctgctccaccatgtgcacaggcctgtaagcaagagtccaactttgttgaaataggaaccatttgagtttgcttcaggccttgctgacctcagaagtttcacattgtcccctggtgacctcttcacaatgatgttagtggtgatggaacaatgcaggacagaaggccttccttactttctttcaacaaaaaaatggtgtattatctagcctgacagtaccctagctggagacagtgaaaataatttacattttaaacaaataatgtttgttattttttcaatctcatgagtgtaagataaaagtaatcctatctcaataccaaaacaaacaaacacgaaaaaccagaatctgaggagactgaagtgtgttgattgagagacagtaagaataacttagtccagctcccctgcctggctgtgaaatccaatgatccagtgtcccactctacagacaaacctacaggtttttcacccaatgcagacagaagacatggtattgaattcatgagtccccgctgagagtcacaataggctggtgtggcacaatgcattatgggaggcacagaatgaagggacaacatgtattcagtggattctgctctcttatcagactgagtcactgcacagactgctcacagggtttctccactgcattctgcctcacataaataaacaccaagagccataggatattagtcaattatattttctccttcagtgtcatacttgagatctctatcatatttgaaattggactcagagagcttcaattattttgttgcaatatatattatctttacaaaaattacctagactactgtgtttctgaaaaataaatcttacaatttattttacttccatgatggtattaaacttgaatggttagcatatcagccagtagtgtgtctggggctggacaacagagagtgtttggggtccattcctgaagggtgtgtgtgtgctcagagctggcatcatccacctattctgactcctgccctctgctaagtcctcacagctgtgaacttccaaacccctgggacaacacagctccactcctgctcattcccctgatccccaaaggcacagggccctgatcctgacccaaacacagagtgggatcaaaaagctgagaggttgtcacttgcataggtggatttttttcctcaaagagtataaagagagggagaaagattgggagaagctctgcggtagctgtaggcacagaaggcaggaatcaggccaatctccaccatggactggtcccctctcctcctcatactcctcactcactgtacaggtgactagacacaggcccaggggaggagccctgggaagcccaagggactctgctttctcatcttgtctctagaacagtatcaccacttctgtgtctcttccacttccagggtcctgggccaagtctgtgctgactcaacctccatcagtggcaggggccccaagatagagggtcactatctcctgcactggaagtgccaccagcactgggggtggttttcatgttaatgagtactagcagctcccaggaatggctccatagctcctcatttgtgaaaacagccattggccttcagggttctgtcctggttcacaggcttcgctgagcatttctgggctccagtctggggataaggctgactatttttctttatcttggcacacaagcattaatgctcacacagaactgtaggccaccggggaaggaagacaaagatatgctgtctttccagtgacagagtttccctgtgcagcccccaacccattcaccaaataagtgcttaactgtgattttttttggtggacaaaatgtggagtatgagaagcactgaagcaaacatggtctaaataatgtttcccagtcctctctcaattctacccccatatccaacccttggcaataataaattgtcatactgtcatatattgaaataaatatctatattagtccattctcacattgctataaagaactacctgagacagggtaatttatgaagaaaggctcacagtctttaattgactcacagttctgcaggctgtacaggaagcatgaattggaggcctcaggaaacttacaatcatggaggaaggacgaggggagcaagtacatcttgatatggcagagcaggagagagagagaaggggaaatactacgcacttttaaacaaccagaactcacaagaactcactcatgatagtgaatcttaagaacagcaagaaagaaatctgcccccacgatccaatcacctcctaccagcccctcctcagcatgagatttgggtggggacacagagccaagccatatcaattcctcaataccagggtcaggcttccctgggaaccaagtccatcatggatcaggacaggaccaggaacacagcacccactgtgtctgaccaaagagcctcaactgccagatgtctgtccatccacaccattcaattagcacctactatgtgccagccttaggtctaggggctcaaaaacagggtggacaagacaggaagtgtccctgtcctcatggaccagacaccatctggtggaagagatgagacaattgagtaataatatcaatacaataagatgtcatcacttagtgaggagaggagaggagagctcagtaatggtggtagaggagccatcagagggttggacaaggaagacagaggatctgagctaagtttgtgaagaaaagtccagatgcctcagacaagatggacaaggaggtgggaagcatgatggctgtgggtccaactagggtcactgggggagactgtttatacccagcatatgtttgtggggaggagggactgaagcctgggtgaggggagagggctcaaggctggccttaggacatggacaggatggtattgagtcacgctgcagaaggagccttcatgggcaagggggctgggggaggccctgagctcattattccaatggaaatatcaaactgcctgttagcctttgtcaaaggtatcaaagagactttttcattcaagatggcaagagaggaatctccctcttagacttctttgagatattctttcttcatgaccgtttcttgcccctggatgaatgctcacatgggagcaaattacctcctcagtcccaggatttcaatttgcacacaatccccccagaatgatcgagacctgccatccctgacccactgatcaggaattctggccttcaggacaacttgaccagatcagtcacaccatgtcccctgacaccatcgtggtgactggggtgaactgtcagactggtttgggtaatacatgtcctgtccctggagttgcagaacctgttcagaaagataatggtgtggatggagggaggctaattccagccacatcagaaagcaagaaagacatggagaccacccttgagctggcacagcatccttgggtctcacatgtgtctctagcgactggaaaaggaactcagatttaactaattctattttctcatctgtcactctccctttcactactgactcctgaagccccaacaaaagcagcactatgggattatggtcatggaatagaggccttgctgctgaacttttcttttttattctaaaaagtacaacacagataatgcatattaactaaaaattataaaaatgtatttaaatgatgtgacaatgaatgtataaggggttaataggagaaaataataaacaatgttaaaaaatacaaaataccaatacactataagagttatactatgtcatggattgtataaatcagtattgtaaagatggcagtgtcctaggattaatccatcaaattaatataagtgtaattaaaatttcagtaatattttaggaaactgcttaacttattttaaaactcaaattgaaaattgagataaaaattacctaagattatttaccaaaaatttgtaatggaagtgataccagatattgagttatttgaccaagcaatattagctaaaatcatgcatgattgagatcttgacatttacataattctcttaaaaattagagtagataggactgatgattttttatgtgaccttggaaatatggctaactctgttcataaaattaagtagagtacctaattcatacttttattaaaaaatccaaacagatttaaaatataatttagaaaagaaaaagtttaaaaactttagtttggaaaaatagaaatattatttttatttcatatgagaaagtacttcttaaataaacccaaaagtcaattcataaaagaaaatttgaagtatttggttgcaattatttgaagctttttttttcccaaagaggaccacagttggtaaaaagagagaaggatatgcaagagtggaaagacattggcaaggacaaagtattgctgtttgcatccagaagacaactttgaaatgagcgaagacagaaaaaaaggaaacccagtaaaaatgttcaaaggacacaaacaagccattcacgggtctcaaaatgagagcagataaatgtgacatcaaaatatgttaaattccaccagagacaaagagaagggaataagatcttcaagtagaaattgtggaatgagccaagcatgtctgtgcatggggagctttccaggccttgcaaaaagcaaagagagtaagaaaagagcaagaagggagtgagaagcccttttgtagagaaaccaagaaaagaaagtttagagtgttagagcctgggccagaaagataaaagagagagaagaggtagataatgtgggatttgagtgacctttgattcctgtgggcatacttctgagtaagacatgaagccactgagggtggaaagctgttaaatgatattgcaaatttaaataaaaaaaaaagatgccagtgaggatgtggggaatcccaaactctcactcacagcaggttgtaaaaacaaattcagctattttgagcaaagtccctcagcacgaagataccttaagagggtgagcatctgtcttgcaccaagtccactctgtacagagacacaaggaaatgtttatgagaaggtccttactaggggaaaagtataaaaaacaagctagttgtcaaacacaaggggaatttataacctgcagttagctgatggaatgctaactagttggaagtaataaaataaaagtattattatgagtttcaaaggcaataaatatataaataaaattaaaaagccaagagctaaagaaataaattattttaaaatatgaacatgcactataattttttttaagtttataccatgagctatttgaaagttagactggaagcacattatatacacttatgtaagagcctctgaaaaagatggaaacacatacgaaggttaaaagataatttaaaacaatagagagttatttcagtagctgaagatatgagtgccaataaaatgaatgcgattcaaccctgtgagcattgctttcataaaaaaattaaaacagaaaatgaatattaatagatgacttaagtgaaatcacaatgtatgtggtgatacagctgaaagacaaacgttttgttagtaagaagggcatcgctaagcctgatgagtgctttgtttagaattcccagctaccctggattcctctccaacctcatgaacagcttcagaaaagaggatcaggacaaccgatgctcctctcattgaaatgcccggatgtggcagagaggcaggaaatattttgggtctgaggacagtgaggatcatcactgagatgatcctgcccaaatgaaaaccactcagggcctccaagggagttcagccatcagctcactggactaggtttgggatgcaacactgacctgccccgacccagagtcataatgagccaggccacctccacccactgggtcagctcatctcctctttatcttttctccttctgacctgtgagtacccagatcagggtggacaagtaagagacacatagcaaggtcttatgtgaatacagtgactctaccttacgacgtttttgggagatacaaaggtacttagaggagctcagtttccaaagcagtgctccaggaagctggaaatctgcactatgctctgggctcctctcctccatctccaccctcactattcaggtgagaaagaaccttatgtcgggggatccacacccagctctgctccataccccctcactctctggctcactgggttgtaaacctgctctcatggccctctctgtccccctgcagtgtctgtggcccaggcagggcagactcagcagctctctgtatccaagggcttgggatagacaaccacactcacctgcactggggacagcaacaatgttggcaaagatggagctgtctggccgcagcagcaccagggccatgcccccaaacacctgatcaacaggaaaaacagccaactctcagggatctcagagagattccctggctcccggttaggaacatggcatctctgaccatctctggcctccagaccaaggacaagcctgcctattactgctcagcctgggacagcagcctcagtgctcacacagcgcctcaggggaagtgagacgaaaactcaggagctcccctagcttcactcggtatgcgggggcgtcatagagcactgtttaaactaaaccaaaaatgacaagggctggtttccacgtgacaaagtgtgtgctattcaaaactattaaaaataatatcataagttaaaataactaaatctgcagtattaatgaatatttataggaaacattgttgtgaatatatttgtggctagatacttacatgaacatacacatgcattaatcagtagtaaaaatgaatgcaagggtaaactaaggaaatatttattttcccagattttccttctcttttatttggagatgctggactaaatgctcagaggttccggtggtctgcctttgagtgtgtgttcagcagggtcacctcaagcttatcccaccttcttatgacctgggcccatgcctgtcctctcattagaatcccctttccctctgtcacagagctctctttattccttctacagacccagacttgttcctcacacttagttgaggcttcctgggccccacgtccctgtttgcccccaacacccacacaagacaatgatcccatgtgtgtgctcttgttgtgccctttccttatcctctgacatacctcaggcagtatctggaaagaacaaatgaagtgggagcgttagcttgtagttgaaaatgatttttgatattttggggaaaatatctggtttaaagatagttttccatcgagataaaaatgcatgtgtgacagcaccacatttctaatggcggaccaaagccccccacatctttgccccccacatggctccagggacattgacttgttaatatacaacccaggagagagcactgtgtcctatgcaactgcaatgcagaggcaggtttctgcccgctcctccaatgaagtgagtagcaaccccaaccccatcttcacccatcatttagatgacccccatacaaccacaacatagaaacacattgatcaaagggcctttttctctttgcagagacccctatttgtttatttggcatgtgagattttagacttttaccaacaattaaaatatactttattagaaaagttacacttcttaagaaactctgattcttactgtgaagttaatacctaatgcatcctataagcatagtaagtggaaaattgttctgtaaggagaagattaatcaatgaaataaaatacaagtatttgagagcaatctaataggtaaaagattagaggacataattgtgaatgccaggtgcaatataaaggaaatgtgggccgggcatggtggctcaaccctgtaatcccagcactttgggaggccgaggtgggcggatcacctgaggtcaggagctcgacaccagcctggccaacatggagaaaccccatctctactaaatatacaaaaattagccaggtgtggtggtgcatgcttgtagtcccagctactcaggaggctaagggaggagaatcacttgaacccaggaggcggaggttgcagtgagccaagatcacactattgcactttggcctgggtgacagagtgaggctcagcctaaaataaaataaaataaaataaaacaaaggaaatgtgaatacctagagttgattaaattgtggcccctcaccttcaacactcgaaaagctcagagtgggtagaaaagcttgttgagttatcttctgatgtcattgacaagataaatcagggacaatagaaggaatatgtggaaagaggtgccagaggctagaggggaaagtgtgaagtagccagcagagaggagcctgctggctgactacttgtgttagtagtagcaggtggtgttgacgccatctcccaggggaaaaccctgggaaacaggaaagctaaaagcaggctcaccatcctcatccctaacagaaccactgaagtgagcacaccagagtgtggggttccctcccggctcttcagatgacattgttatttggcaccaagctgatgttagtatgttctttataaatatatattgcacaaagaattgcataaaaccttcaataatttaatgaggactttctcacttaaaaaggtttttatgtctcttctgtggcccccataggtagccggggatccctcactgcatttcagtctgacaactcatcacatggacagagtccaccgtgtgtgactgtgtgtctgtgataataggtggcaaagcttcactgtcatagccgcacctgcttcattgcctggtgcttgcctttctgaaataggaaaataaactcttaccaatgtgtcataattaggttctatttaaaatctcctaccaaagttaagagcagcctgcacaactggtccacaaaatgagaaacctccaatttatttggactcttttctctaccctacccagtgatccaactggtcaccagccatgtggattctctctccaaaacgcttttaaattcaactctcctgtttactttccattctcatgtcttatgtcaaatattcatgtcacttacctagttctgatcagttctctggctccatggacagctcccccaactctgccttcctgaccatctctgggctgcggattggagatgaggctgacttctcctgtcagtctcatgatgaaagctacaatctcacagtgctgcaggcccattgggcagtgacaggaaaactccccagagcaccctcaccctgagtctgccatcagcctctccccaccagcatgggttgctttttcctgtcccctgtttgaatgtttgaattcaaattttctgtttatgtgtctctctattttctttccaaaatacacaactttttctttcttgtcttcatggatggtttttctggtccctgtgaaattactttatgaagaatatttagtttaaaacatagtttctgaacattgtcattttaacattgtgcactgggtcattcattgtgtgaggggggctgttctgttcatggttggacatttataagattattgggactcacacatcagatgcctatagcaccctaattcccaaattctaacaaacaagcaaaaaatgtagacattgcaaaatatcctagggagacagcactgcagaatcacccttgtctgagaaccactggattaaaaggacatggtttcacgtattgggcagccttttgtgttgaaccctccttatcccattccactgaatataaggctacatgcattatatctcgatggttccaaatttcctcttaaacaaatgtgtgggatacaactccaaaggttatgttgacagatgaataatcctctgaacaccattagttcagaaaacctgctacccaatgtacagcatctcttgctgaccagagtgtggagtgaaacatttgaccaaactgtgtgcataattgctaattcaaatttttaggtaaaacacctaaaacataacacattcttctctacttatcctcttaggggttgcttttcaagcatggtgtacaaaattatgacaaggcctcgtatgtgtggagtttacattttagaatgggtagacgacagtagacaagagcagcctcagaactgagcagtcagtgaagtcctttttttagccctagcgctggatgcaaattttaccagctgccatttgtgtttttgggcttgctccacccagtacagtccccatgaactgcatgttgatatgtatatttcaaagttaattaattaaaactaaataaactttaaaaaatattcctcagccacaccagcttcatttcacctgcctcctggactcatgctctccatccatggctctcatgctggagagttcagacacagggcatctccaccatggcataaagttctactgcagagcacagtctgtgacaatctatttaacacttccttaggccagtttcttcattacctgtaatggggatatagtaacactcaagttctcttcacagtctggaacactattctctgtgggagtattacctcggccccttcttcctacagaacggaggagtgataatgtaactagtattggccaataagatgaacagaaatgagaggtgtaatttctgagcagtagatgtaagattagcctgtgctttgtcaagttctatcatctctgacgtaacacccacagtgttctcacagaattctctcaaccatcctgcatcctgggatgaaggtgaagtgaactgaagccccaagcatttcaatcagagatgggaatggtggaggagtgagaaatatacattcgttgtgagtcaccaagatttctgtcaatttctcactgcatccaagcctagccagtactgagtgctatggaaattataagtgaatgtggggagccacaatgacaaaattaacatctatctataaatatatataatatatattaattacattatatcatatactaatattaatatataataaatatataatatataacacttacatattatataagtatataatatataacacttacatattatataagtatataatatacaataattaatctatattacatataatatattaatataaatatatatacataatttgatttgatgcaatactgtgaacatttagtagactacggagattgcatgatgtttcattttattcactggcaaatatttaattaagctgtcaccataataaacattaaaacacacagaattgacaaaataattctcctgagctgtggatatacaagttagacaactgattagaagcataggttcactcctgtgccatttgtggaatttttacaacttatttactttaagtgatgattttaagcataattggtttttgttcttgctttttatttattcaagcagaagaaagacacaagaatgataacccacatacatacagagtagtagaatggcaagagctaattattctcaaacacaaattcttaaagataaatgtaaaatatttgaattaaacattttgctatccaaaaaaaggtatgccgtttttttcctgagtactccagggcaggaaagtatattcatcaatccccctggtgtccgctttcttaacacattgttcatattggtatatatttttttcttattacttaacttactcatcctatatattgtgtttcctaaatatatttcaaattcattctcagccttgtgatttccctcgccctcattatgtcccatgtcctgctggggctcccccataccacccctctcctcatctgtaatgccccctcccagttcctgccctcctgggaactgctgtgctcttttctgccctgagccttgttacctccttcttgtactacctatttgtctcagtgagctcctcttccattcttcaaaggctccagagccctagagaagagcatcatctcaaaaaatttcccaagaagctgcaagtaatgagagtgtctaagaccactctttctgctttatggcaattttatatttaacgtggtattgagtcttgctgaattttcagtctgaagtcataatgtgctcaaatatacaaattccagagacacagagcagaatggtggctgccaggagctgaggggaggaggaaatggggagttgctggtcaacaggtgtaaagttttagttatgcaagaatatgttataaagatgtgctgtgcaacacttatctaaatattaattattaatcaaacaaaaaattcaaaattattaacacacatttccccctgggtttactggacagatgattttatatttgtctctgctaagtagactaaggtgtaaggatttggcacgaaagttgtaaaccacaaacccagccaaaaacaaaatattctttatacagtttttcaataaataaaattaatttaatattgctagtttaataaaatagctgtgtcttctaagttatagataaattttgcatatttttcactttaaggatcttacttaggtaaacaactgcatataccaactactaatattactaagaaaaaatgatttagagaaataaaaataattttcttgtgtctcagttttcacatataatctaaataaatttttaagtaactaaattagatgaatataaatgaagtaaacacttctatctaaactttttgtataatttaaaatcttaaaaaataaattaaataataggtactcttaaaaaagtgtaggtcatttaaaattaaaaatatatattttggatatagttataaaaatattaaaatagttctcatgtataaaagatgaatttatgagagacaattcaaagtttcttacatcctaggttttgagtaaaaattattgttaaaataattaaaaattctaattaatatataattcaatatataaaataagacaaaaataaaaatactaaatatatgtttttaagttaaaaaagcaaagtcataaaatatatgctttattaaaataattttgccaagttaagatgttatataatggttacttataaagcaatataaaataaattagagagatataaaatattataaatatagatatctttttgtaaaaaacattagaacataattttatattgaacaatcttatataatttttgtcctaaaataagatgatttactattttaagaagacaaatcaaaatgtcccaacaagtcttagtctatgtaaattataataaaatacatttgggaattatgtcccaacatatcttactctatgtaaattatagtaaaatacatttgggaattatttaataaaattaagtataattaacaggactataattttaaaaattatgtcttcctaaatattaaactttaatattgaaaatacacaaatacaaaactgaatattttgattttctatgtccaaacacagttttcttaatattaatttactctaaataaaagatttaaacattgatttttaattttaacatctatttctctttaaaacttctcaaaattacacttcaaaagttcaaattttgttaatattttcacacataatttacagacttttattgtcatacctttcaaaaaaatgtaatttttttacttcactgggacaataactcttttctttaacctttttttaaattattatactttaagttttagggtacatgtgcacaacgtgcaggtttgttacataggtatacatgtgctatgttggtttgctgcacccatcaattcctcatttatattaggtatttctcctaatgctatctctcccccagccccccacccccaaacaagccctggtgtgtgatgttccctgccctgtgtccatgtgttctccttgttcaactcccacttatgagtgagaacatgcggtgtttggttttctgtccttgtgacagtttgcttagaatgatggcttccagcttcatccatgtcactacaaaggacatgaactcatccttttttatggctgcatagtattccatggtgcatatatgccacattttcttaatccagtctatcagtgatggacatttgggttggttccaagtctttgctattgtgaatagtgccataataaacacacatgtgcatgtgtctttatagtagcatgattcataatcctttgggtacatacccagtaatgggatggctgagtcaaatggtatttctagttctagatccttgaggaatcaccacactgtcttccacaatggttgaactagtttacagtcccaccaacagtgtaaaagcgttcctatttctccacatcctctccagcatctgttgtttcctaactttttaatgatcaacattctaactggtgtgaaatggtatctcattgtggttttgatttgtatttatctgatgaccagtgatgatgagcattttttcatgtctgttggctgcataaatgtcttattttgagaagtgtttgttcatatcttttacccacttttcaatggggttgtttgctttttcttgtaaatttgtttaagttctttgtagattctggatattagccctttgtcaggtgggtagattgcaaagattttctcccattctgtaggttgcctgttcactctgataatagcttcttttgctgtgcagaagctctttagtttaattagatcccacttgtcaattttggcttttgttgccattgcttttggtattttagtcatgaagtctttgcccatgccaatgtcctgaatggtattgcctaggttttcttctagggttttttatggtgttaggtctttttttttttttttttctttgagacagagtctcgctctgtagcccaggctggagtacagtggtgtgatctcggctcactgcaagctccgcctcccgggttcctgcattctcttgcctcagcctcccaagtagctgggactacaggcacctgccactgcgcctggctaatttttttttgtattttttaatagagacgtggtttcaccgtgttacccaggatggtctcgatctcctgaccttgtgatctgcccgcctcggcctcccaaagtgctgggattacaggcgtgagccaccgtgcccggccatggtgttaggtcttcattcaagtctttaatccatcttgagttaatttttgtatactgtgtaaggaagacatccagtttcagctttctacatatggctagccagttttcccagcaccatttattaaagggggaatcctttcctcattgctttttttagtcaggtttgtcaaaaatcagatgattgtagatgcgtggtgttatttctgaggcctctgttctgttccattcgtctatatatatgttttggtaccagtaccatgctgttttggttactgtagacttgtagtatagtttgaagtcaggtagcatgatgcctccagctttgttctttttgcttaggattgtcttggctatgcaggctctttttaggttccatatgaactttaaagtagttttttccaattctgtgaagaaagtcagtggtagcttgatggggatagcattgaatctataaattaccttgggcagtatggccattttcatgatattggttattcttatctatgagcatggaatgttcttccatttgtttgtgtccccttttatttcatcgagcagtggtttgtagttctccttgaagaggtccttcacattccttgtaagttggattcctaggtattttattctctttgtattaattgtgagtgggagttcactcatgatttggctctctgttagtctactattggtgtataggaatgcttgtgatttttgcacattgattttgtatcctgtgaccttactgaagttgctaattagcttatggagattttgggctgagatgatggggttttccaaatatacaatcttgtcatctgcaaacggagacaatttgacttcgtcttttcccagttgaataccctttatttctttctcttgcctgattgctctagccagaacttccaacactgtgttgaataggagagggcatccttgtcttgtgctggttttcaaacagaatgcttccagtttttgcccattcagtatgatattggctgtgggtttgtcataaatagctcttattattttgagatatattccatcaatacctagtttattgagagtttttagcatgaagggctgttgaattttgtcgaaggccttttctgcatctattgaggtaatcatgtggtttttgtcgctggttctgtttatgtgatggattacatttattgatttgcatatgttgaaccagccttgcatcctagggatgaagctgacttgatcgtggtggataacctttttgatgtgctgttggatttggtttgccagtattttattgaggattttcgcatcaatgttcatcagggatattggcctaaaattctctttttttgttgtgtctctaccaggctttggtatcaagatgatgctagcctcctaaaatgagttagggaggattccctctttttctattgattgaaatagttttagaaggaatggtaccagctcctctttgtacctctggtagaattcggctgtgagtctgtctggtcctggactttttttggttggtaggctatcaattattgcctcaatttcagaacctgttattggtctattaagagattcagcctcttcctggtttagtcttgggagggtgtatgtgtccaggaatttatccatttcttctagattttctagttttcttgtgtagaggtgcttatagtattctgatggcagtttgtatttctgtgggatgggtggtgatatctcctttatcattttttgttgtgtctatttgattcttctctcttttcttctttattagtgttgctagcggtttatcaattttgttgatcttttcaaaaaaccagctcctggattcattgattttttgaagggttttttgtgtctctatctccttcagttctgctctgatcttagttatgtcttgccttctactagcttttgaatgtgtttgctcttgcttctctaattcttttaattgtgatgttagggtgtcgatttgagatctttcctgctttctcttgttggcatttagtgctataaatttccctctacacactgctttaaacgtgtcccagagattctagtacgttgtgtctttgttctcattggtttcaaataacgtctttatttctgccttcatttcgttatgtacccagtagtcattcaggagcaggtttttcagtttccatgtagttgagtggttttgagtgagtttcttaatcctgagttctagtttgattgcactgtggtccgagagacagttttttgtgatttcttttcttttacatttgctgaggagtgttttactaccaattatgtggtcaattttagaataagtgcgatgtggtgctgagaagaatgcatattctgttgatttggggtgtagagttctgtaggtgtctattaggtctgcatggtccagagctgagctcaagtcctggatatccttgttaaccttctgtctcattgatctgtctaatattgacagtaggatgttaaagccttccattattattgtgtgggagtctaagtctctttgtaggtctctaaggacttgctttatgaatctgggtgctcctgtattgggtgcatatatatttaggatagttagctcttcttgttgaattgatccctttactattatgtagtggctttctttgtctcttttgatctttgttggtttaaagtctgttttatcaaagactaggattgcaacccctgctttttttttgctttccatttgcttggtagatcttcctccatccctttattttgagcctatgtgtgtctttgcacatgagatgggtctcctggatacagcacactgatgggtctgactctttatccaatttgccagtctgtgtcttttaattggggcatttggcccatttacatttaaggttaatattgttgggtttgaatttcatcctgtcattatgatgttagctggttattttgcccgttaatgatgcagtttcttcatagcttcaatggtctttaccatttggcatgtttttgcagtggctggaacctgttgttcctttccatgtttagtacttccttcaggagctcttgtaaggcaggcctagtggtaacaaaatctctcagcatttgcttgcctgtaaaatattttatttctccttcacttattaagcttagtttggctggatatgagattctggtttgaaaattcttttctttaagaatattgaatattggcccccactctcttctggcttgtatggtttctgctgagagatccactgttagtctgatgggcttccatttgtaggtaacctgacctttctctctgggtgcttttaacattttttccttgatttcaaccttggtgaatctgacaattatgtgtcttgggattgctcttcttggggagtatctttgtggtgctctctgtatttcctgaatatgaatgttggcctgccttgctaggttgagtaagttctcctggataatatcctgaagagggttttttttttttgtttttttttttttggttttttttgagacagagtctcccactgtcacccaggttggagtgcagtggtgcgatcttggctcactgcaaactctgcctcctgggttcccaccattctcctgcctcagcctcccgagtagctgggactacaggcacccaccaccattcccggctaatttttcatattttttggtaaagacagggtttcatcatgttagccaggagggtcttgatctcctgacctcatggtctgcccacctcggccttccaaagatctgggattaggaggcatgagccaccgcacctggccctgaagagtgttttctaacttggttccattctccccgtcactctctggtacaacaatcaaacatatatttggtcttttcccgtagtcccatattttttggaggctttgttcatttcttttcactcttttttctctaatcttgtcttctttgtttatttcattaatttgatcttcaatcactgatatcgtttcttccacttgattgaatcggctattgaagcttgtgcatgcgtcacgaagttctcatgccatggttttcagctccatcaggtcatttaaggtcttctctacactgtttgttctagttagccattcgtctaacctttttcaaggtttttagcttccttgcgatgggttagaacatgctcctttagctcagagaagttcgttattaccgaccttctgaagcctacttctgtcaactcgtcaaactcattctctgtccagttttgttcccttgctggcgaggagctgtggtcctttggaggagaagaggcactctgttttttggaattttcagcttgtctgctctggtttctccccatctttatggttttatctacctttggtctttgatgttggtgacctacagatggggttttggtgtagatgtcctttctgttgatgttgatgccattcctttccgtttgttagttttccttctaacagtcagacccctcggctgcaggtctgttggagtttgctggaggtccactccagaccctgattgcctgggtatcaccagcataggctgcagatcagtaaatattgctacctgatacttcctctggaagcttcgtcccagaggggcaccgcctgtttgagacgtctgtcggcccctactgggaggtgtttcccagtcaggttacatgggtgtcagagacccgcttgaggaggcagtctgtccattctcagagctcgaacaccatgttgagagaaccactgctctcttcagagctgtcagacagggacgtttaagtctgcagaagctgtctgctgccttttgttctactatgccctcccccagaggtggaatctacagaggcagtaggccttgctgagctgtggtgggctctgcccagttcatgcttccctgcctctttgtttacactgtgagctactcaagcctcagcaatggcaggtgcccctccccccatcaagctgcagtgtcacaggttgatctcagactgctgcactagtagtgagcaaggctctgtgggcctgggacctgctgagccaggcaacgggagggtatctcctggtctgctggttgctaagactgtgggaaaagcgcagtatttggtcaggagtgtaccatttctcccagtacagtctgtcaggcttcccttggctaggaaaggggaatcccccgaccccttgtgcttcccgggtgaggtgacaccccaccatgcttcagctctttgggttgcacccactgtccaactagtcccaatgagatgaaccaggtacctcagttggaaatgcagaaatcacctgtcttctgcgtcgatctcactgggagctgcagaccagagctgttcctgtttggccatcttggaagagaccttccctgtgtattccgagccttctgcattctgccatcactgcagcctcctcatgttggatggacctgatatttttgcttttctagtaattcagaaatcctcagtggaaaggctgtttattaatatgagttatctccagacagggcaaaggtgtggtctatggatgctgtggattagcaatgaccaggctctcaggtgactccactcatgtgattttcacagaaagactgctgtctggccagtgagcagcacagggcactgtgagtcacactcagtgtctgcacagtgaaaacccaaaacttgccacccccccaaactccccagggctgggtagatggagtctgcactcactgacacagatttagcagctagatatggtcccagcacccccaccttcttccaagtcctgcgtgccagacaccccgacaacagctcccagatactgataaatccatggggagagttgggggtaggcagtgggagcaacacacttgcatccataacccctcctttgtgaggccactgaaggggataagagaggcctggagaagccactccagttctggacctcaggagggctgtgtccactgtgacctgggcacctattctcctgtgatattctatcatttctcaggtagggacaggtctcacgtcctggggaagccccctagcctgagttcttgccctgtgtttcactctcaccctttgtcctgattcctcacccacgatcatctttgcttgcaggttccctctctcagcctttgcttattcagctgccctccctctctgcacatctgagaaatgctataagacttccctgtaccccaagtagtggctgcattgttggaggctgtcacatattcttgtaccagcagaagtcacggagccttccccagtatctcctgagatactactcagactcaagtaagcaccaggactctggggtccccagtcacttctgtgaatccaaagatccctcgggcaatgtgcagggattctgcacatttctgagcagcctgagatcaagtccgactattactattttacatatcacagcaacagtggcactttcactgtgctccagacttacggggaagtgagattagaacctcccctgcattctctctgccttgtgcaggcaacaatacactgtctgggaccgagtgtggctcatcagtagcagctttgttgtttgtatttttcattcttcagtacagggtgggacctttctactggcctccattaatagtgagagtcaaacaagacagtctgtgggtgactccaaagtctaactcagggtttccttatgttagttagcttggactactcttggctcctccccagagatctcaacttctctggaattctccaggtgccacaagcactgatttcagtcttggccttgcacctcccctgagcagcttctgactctcctctcattacatctccatttatggcctgtcacccactcaatgtgttaaaaggtaaagcattttgcaaagtacttatcctgaactttagccccaaatccacccagcttccctagcccaggccagctctgcttcttatgaggctgatgagaggtacaagggctgcgacccttgctgagtccattcctgaaaatgcccccaataaagcctgattagcgccaatgccacaggacattgttctgtttcctttgcaggtggtgcccagtgaggaaagttcttcctcctgaatatgaatattttggagcatgaaacagctgagctgatctggggaggggaggcaaccccttgtgatggtggtcagattgcttggttgggattgtcacagaccatgtgataatgggattatattgcatatcacagatgcgctggaccctcaagtgtgctggggaactctggttaaagaatagaagtgatccctttgttcatattcactatgctggatgcccttttgagatccctgcaggacgctaaccctctgactgcggcagccttgccctttgatctgaagcttttatcatacattgtcctgctcaggggatttgggtggggcgttactcctatatatcatcacaagaaagggattctctggagactaaatgcaaactggaatatcccctggaggctgtccccctgattgggaaatatgaagagactaggggtgctcagtgtttaaaataaaacttcagagagtagagtctgagtgtaaacccttcaattccatttaatctctacaaatgtatataatgtcaaaacatagttatgtcatatatttacacatgtgcacacaaatctattaatacatgttcataagttcacatatatgctttatgttatacatatatgcatttatacatcaactgatgttattataatcatagttttacagactcaattttcctttgggtttttccacatttccccactttctttaacacttatttcttgaaaattttggtggctgcttactgagattttactaaaaaagagcttcagaatttcatttagagtagatcttgtggcaaattctattttttttgtctgaaaaaatggtattttttctcttttttatttttaaaacttatcttgaagcataatatgtaaagtgaaatttgcagatcttaattgtaaatttcagtgtgctttttatgaacacatatactcatgtgccccatgcgtactcacaacatttccattactgcagaattaaaacattttgttctagtcaatgaaattattccattacagaatagatatgtgtaccacatagaatgtgtacctgagacacacttcccctggggactccttataaagtgcggtgaattgtgtgtcttttttcccattgaggaggccaatgtggaaaactaaagactgagatgatgtagaaaactgccctgagagggaacctcactctgccctgaggtagggagccagcactggtcaaggccccggtggaggatggcacctctgttgggtccacctggcctctggtcacaggcacgatggacctgggcctgggcagcagggggcgctgtggggctggcacttagagtctgtggggctcttagctgggaaatgatacctggccctggcctctgcctagggctcactggggccagcagctgggtcctctctgggccctttgggagcctcagtccaggtacatcccaggcctactcttcccagaaatgacccagccactgggactgcacacgggcccagggaggggcacgcttgggcaggggaagaggagcacatttgcatgaaaggcccatctctctcctctaaggctagagggtgaacacgagagacctgccgcgtggcttcctctgcagagatccggggagtctgcaccatggccttgaccccactcctcctcctcattgtcctccttcactgcacagtccaggacggcacaaagcatcctgatcccccagctcactgacaccacctcccaactcatgccagaactgtccttccctgttctgctttattcagtgtataatggctgtctgtgttttcgggatccctctggcagcccgtgccgactcagtcgacctctgcatctgcctccctgggagccctggccaagctcgcccacactcagcagtcagcatagcagctatgccattgaatgctttcggcagcagccagggaaggcccatcagtacctgatggagcttaagagtgatggaagccacaccaagggggctgggattcccagtcactagttctcagtctccaggactggagctgaccactatagtgtcatttctacaatcccgtctgaggatggagctgactatatctgtggtacagattgtagcattggtgtgccgtttgggtaaagcacagataaatggggaaatgaggcaaaaactgtttttctactctgctaccaaggttgaaaaatggctctcagaaccagtgtctgctgacctgcatactcaaatatgttatgtgtgtgtgtgtgtgtgaatgcgtgtgtgtgtgtactttaattttacgagtagagagccagatattttctgattcctgcttccagttcccttggaaacagctttttaggccaggccttctagggagtgcactctgatctgtaactattgtgcaaatattacaacagagcctgtctcctcctgctggtctggtgtattgtggctatataggggggtgcaaagaaattctccttttcatattcagacactgggactcagctgcatacctcagtcctgtcttattgagatcatttaaatgatcaatcttagaagaaaacttctgacttaaataaattttagaagtctatcaacatgctagaaagcatattccagataaataaaaatagaataaagatttatagagattgagatgaaaagctttaaaccctttgggggtttctgaaggtattctcaggtgttcagtgcctgggatttgggagtaagggataaggaggagaacttatttccaacacactgaagatgacaacagataagcagaaagttaccaaagaaggaggaatagaaatagccatgaatatcatcctggtaaccctgatctggaatgaaggatttcatttatttacttatttatgtatttattttcaaaataagtacatctcatggagtccttggcaaaagctgaaggaagtattgcttcaggaaatatctgtccagtaattaggaaactactaatgtgattgagcagagacttcattaacttcacatgcaaagaatacagacttgcagaaccctcctggaaaaccatgaaacaatacatcatcaacaataacaactatagcaaaaacagcaacaacatcaaccaaaacgctttacaaaaaagttctaatttccagaactgtcacattatattatttaaaatttccatttgtcaaagcaaaataatgaggtaggttcaagacacaggaacatattgccatatataacggaaaataacaaagaaaaaaacattaaaaaaacaaaaaaattaaaagttgacaaaaactattttcaaagaggcagaaacactggtcttattcgaccaatacttcaactccattatttctccatttgctcaaagaaattttaaaaatgtaaaaatgttcaaaaaagcatgaaaagaatgtatctccaaataaagaatattaataaaagatataaaagaaagagtcattgaaataaacatagattaattgatattatcctattacaggaatagaatgaaataagggtggaaaaatacgcaggacctaaagaccctcttgacaccatcaagtgtaccaatatacacataatgaaaggcccagaagggtaagagtgaggaaaagaaacagaataatgtaattgaaaaatggtaaccaaaactttcccaaatttgacaaaaagaaacatactcaatccctaaaaagttcaataaaccttaatcagcattaatcggaactcatagatataaaacttatggaaagcgtcatggtgggataaagcttactaagttctaaaaagtcaaatagacaaagacggttacaccaaaagtgtgtcaatttctgtttcctgccatgatgcaatagatggagttcttacaccataaacaacactttaagacataatcgagtgcatgtaatgactatttccagacagtgaatattggccaacagggataacttgattatgtaacctcagagaaaggaccctaacacgcaaatgagcactgcagtggacacggatttctttttcttcactttttttttttcgagttagggtcctgctctgtcgcccaggctggagtacagtgatgtgatctccgctcactgcaaactctgcctcccaggttcaagcaattctcctgactcagcctcccgaatagctgagattataggcactcaccaccatgcccagctaatttttttgtccttttagtagagagggggtttcgccatgttggtcaggctggtcttaaactcctgactgatctgcccacctcggcctcccaaagtgctgggattacaggtgtgagccactgcacccagccaacacagattttttttttttaattatactttaagttttagggtacatgtgcacaacgtgcaggtctattacatatgtatacatgtgccatgttggtgtgctgcacccattaactcgtcatttaagtatatcttttttttttttttttagacggagtctcgctctgttgcccaggctggagtgcactggctctatctcggctcactgcaagctccgcctcccgggttcacgtcattctcccgcctcagcctcccgagtagctgggactacaggagcccgccaccacacctggctgattttttgtatttttttagtagagacggggtttcactgtgttaaccaggatggtctcaatttcctgacctcgtgatccgcccgcctcggcctcccaaagtgctgggattacaggcgtgagccaccgcgcctggaccacagatttttttttggagacaatttttggcccagaaggaggtggtgaccaagataatcgtgagctttttacacagctcagaacacacagatgagaagtcagaaaaacatagatggctgagactttcagagcaagacactgaaaagcaggcagctacacagagcaaggtccctgcgctctgcatgaggcccctttggatttggttgggcaaaacatgacaccttgcagggggctctaatttaatgaataggccttcccctactgggaactaagattcatattttttctctctgtcctgttttttcaccactgtatctacaaaccctaggactcagcctagcgcaaagagccaattaataccatgtttgttgaacgaatatgtgaattcacctaaatagaattctcagtaagagaaaaagatctgaggaaaataaagtgatttttactgctttatgtgtattttgagtttgggttgtgaattgattcaaggggatatattaaattagaatgttgacctccgtgtttagagaacaagagaggaatatgaacttgagtgctggaaaggtgaccagcaggatggactgggtcccatgggtttgtgcagagaccatggaaaaggatgagcctccagttactaagtaattgaacaagatatattttaggtaaacacttattttataatcacctgttggaatgggtgataactgtagatgtgactgttattcattgactctctgaaaaaattatttattcaaggcaagaaagattggagaatagttttatcttgaaacacttttcataaacatgacatattcttgctaaagcagataccatattcatctccaagctggaagggttatctcatcttcccaaacatgcaccccttatagtatattttatctgcttttatggcatgtccactttcttggtcacagacattgtaagcctcagagtttaatttgtttctctactgtatacgtatggcacctccagttggtcactgaagctggagattgaaatcctctacatcccccagatctgtcctctggctctatggcgctgtcctgttccatcagacctacattgcccttccttgtgtgaaccctaacctaagtccaatctctactccatgaaagctgtctgtaacagaagcctggcacctctttctcctttttatgaaataaatatctatttctatagatagatctagatctagacattaatagctccaaatctgtagaggacaaagtgcctagttctcaggtgataaccaacccacatcttctgtcctggaatatccagccccagatatcaccccattttctcctccctgtctcgctaaatatatattcacccaccaagccactgggtttgtagtaatttgtcacaacaagaacagaaaaatatgtggaaaagaatggaagaggagtgttgctgttaaaaaaaatacttaaaatatggaaatagttttggaagcagacaagagatagagtttggcagaattttggaaagcatgttagaaaaatcctagattgctttgagcatggtgttaatgcagatatggttgctaaagacttggctgggatgggctcagtaggaagtcagaagcatggtagcgaaaaagctacattttctttcttttttttctttctttttttttttttgagacagggtcttgctgtgttgcccaggctgcattgcagtggtacaatcttggctcactgcagcctccacctcctgggttcaagcgatttttgtgcctcagcctcccaagtagctgggactacaggtgtgcgccaccatgcccggctaaggttcgtaattttagtagagatggggtttcaccatgttgtccaggctagtctccaactcctgacttcaaatgatctgcctgcctcagcctcccaaagtgctgggattacaggcatcagccactgtgcctggtctagttacatttttcttagcaaatacctaattatacatctacagactggaagtagaaatacagccagtaccagcactttgggagaccaaggagggcagatcataaggtcaggagatcgagaccatcctggccaacatggtgaaaacttgtctctaccaaaatacaaaaaaatttagccaggtgtggtggtgcatgcctgcagtccaagctactcaggaggctgaggcaggggaatcacttgaacctgggaggtggaggttgcagtaagcccagacagatcacaccactgccctccagcctggtgacagagtgagactccatctcaaaaaaaaaaaaaaaaaaaaaaagaaagaaagaaaagaagataaaagaaatacatccagtaaaggagctcctggtgcactgatgggagttcacagggaattaagagcgctcttttgacttttgtgggaaaaccggaggaaaggggatcattgttttttggtggaaaacaggttggctggattgtttcatgcaattgtatggaaagcagaacaggtgagcagcaaacttggatatttagctgagaatatttccaagcaaagtattaaaagtataacctcattcattcttgctgcttacagtaaaattttgtgataaaaaatgtgaagtaagggaggaagtcttaaatggaaagaaactagggcatgataattgaggagattactagcatatttcgccaattacttgctcattccctcttttctgggagaccctaaaagtaactcatcatttactgttttccatccgcttccttccttgtctagaatatgggcctggaccctccacaagatgcgtagagaagtcagaaggccttgtcctgtgcaagcattcaagcatccactcctcgcactaatatttctagacagcaaactggtgatccttgctcacctgaaacatacatacgggttggaggaagacagaacctaacacaccttacctgtgtgatgttcagggctggcctctaacttctgagagcttcatttcactccacttcctacaaggattgctcatgccctccttcacttgtggtgaagttcaaacaatacattagatttgacatctttgccaagagctgtagagtgcaaggtgctcacccagagctacatcttccagcagatgaggctcacagttaaatcactgctatggtgtccgtcaactcaggcactgttgtgccttttcacagagcatcgcctgttaactgcttcacccacccactgtgggagtccaggtaggaggacaatgcctccccactagctggctcctctctggttgtacctgtgggtcacacatgcaggtgacggtttgtactacctcctacctggctgtactccccaaagccagggctgacacccctcactgcacttccattccatcccatcagtcacaggaggcagctattggctcattaccctttgcaaggagttcaagggtagaagtggcccatttataagaatatttatatggactatcttgtatatcctgtgaatcatgatactgttaaatcaactctaatacatcatgtttatgtccactgaaatgatgatgataaaaggaaaagtgatatctggacacgcagactgaaaaagatcccaaagattctgcacacaaggcccctattctctggggacatgtgggaattcaatggtcttgctgacatatagagtttgcttcactctgtgtcaatctgaggcatttgtgacctcagagttgtgttttctaagaatttaccatgtgtggcagctggacttcaagttatacctaaatatctctgtctcctagcactcacatccctgtacatattgaaaagggatcactagtacaattgataggatattgagaaaatgactgatgccaggccataatacactttgagttttgcgttctgctctctcagatcacttgctttggggaaagccagttgccatttgtgaggacactcaagtagtcccacagggagtttcatgcagcaagaagctgaggcctcctgccaccagctttgtggctcagtgaaactgtaagttgattctattgccttggtaaagtcttctcatggctttagttccccccactgaaatcctattttcaacctcatgagcctatctgagccagagccaccttgctaaactgctcccaggtttctgacccacagaaactgtgggattgcacatctttgcagttgctaagttttgtagtatttgatgtgaagtaattgaaactggatgcatcgagagaggggaatggaggtggcagagtgggtggaattaggcctggaggtctgctttcagtgagatgtgatgggaccatggcagacacctccctgtttctgattccagtggattgcttactgggcctggcctttttcttatactccatgacttcattgttaataccctacaggaattctgtatgcgctatgtcttatccatcttccttgggtaaatatttaaatataaatgaatcaaaacacatgggccactttctaatcttgattgttcaaaactgaattcctcaaattgaggggtatgattttctttattgtccttggtgctcgtctgccagtgtctatcaatggtagaatcatgtaaacagtcccctcccctattttgtttcactctctgaggacgagagagaagtcttggccttcaacagaaaatggtcaaactagaaagagtaacacttttgagctcctcagtgaatgtggccttggaaaaccccttcacctgggcagcaaaggaagagggagaaagacagagcctgaactggtaggaagtcctacctcaaaaacatcagtcagtcctcacatggatggccagggcattaaggagaactaattaagttaatttcacattctccatgacaaatgctgttgtcatcagtagggacctctcctctctttttccatcctcctacctgttctcactgtccctgacttacccacagtgaactttatgttttcaccttttatatccctatgcctggtcctctgctggcctgtgctgatcttttcataaatatttttgaaatgagaagacgcattttcttaagtaccatgaaagtcgacatcacatccatctttcagggtcctgctcccagactcttctgacttatctgttcactgtgctgggttggcagggaaaagtcatctgcagcagaaaaagtgacaaaatggagatacatagtgtgtcttggccaaaaatcagccaacagatgagagagatctaggattgtgagaagttctgccgttccccagcacctcacactatttgatgtctcaatgtttgtacatatcactatattttctagaagatgcactacatctagaaatagtgtttgctttgtttgtccccaagcaggaccccactctccactcagagccagttcacagttgccttcttccctggcccctgtggaaggagctgctcaggtgtttgctcccagagccctccgcattttccccttactgcggcctcctcacaatgaacaattgtcatgtttttcatttctcctgttcctgttattctagaaatccctcaatcaaaaaggatggttatgaatataagttacctgagacagagcaggggtgtggtccatggatgctgtgacctgacagggacccagcactcaggccaactccactcacatgattctgactgaaagactgaagtgtgcagcagggggaaatctgggtctttccaagctctgaacagtggtgcccacatatctgttatccctgggcaatggagcctgcactcactgaggaagataccacagctgtgtcttctctgggctgggtagagtctcctactcacaggtctgtggaaggtgcaggagctgcttcctcacttactcctcccgtgggacaaacgctgagtctcacccaccaacccaccatatctaaagaatcatgctcagacttcagctcttcctagggtggaacaaagattaccaggaggatacacaaatttgtgtggacagatcctcccttttcaggccactggagaagataaaagaggcctgagttaagcagcttcctctgtggggccacaggaggcggtgtccaccatggcctggacccctctgctcctcatgttcctctctcattgctcaggtgagaactggttttaggtgtctagggttagctccttagcttgcgtcagcctctctggctcagatccccaagacatgtatctctagttcctgccccagcccccatgagtgtctgtgcttgcaggttccctctcccagcctgtgctgactcagatgacctcactctctgcatctccgggagcatgagccagacttacctgcaccctgagcagtggcttcagagttggtaactttgcaatatagtggtcagctgaagccaggcagccgtcccaggtgtctcctgagatactactcagactcaaatatcactcagcaccctggggttcccatccacttctctggatccaatgatacattagccaatgcagggattctgtacattcctgggctgaagcctgagggtgaggctattactgttgtacgtgtcacagcagctccaagtcagcactccagacccactgggaggttacaaaaacctcttctctgatctcctggcctggtgtagtcactcctgctggtggctctaataaagtctatctcactgggtgacttatattttagatcttcaaccagcacctgattctttttttcagacaagtagatctgaaaatgtgactttattttcttcaattccactttcatattgattcatgctcataccttctcatttctttctggttttcacaggcagaaatcccttgctcagagacaaaaattctctaaattgagactttggaggagaccaaaagagagtggttcgggccatgcccggctcagagtctaggagtgactcagagatgcttctggtcccagagcttcaatctaggcattggatacaataccagcattcacaatggaattgtattctctatattagcaacaaaccatcacagattttgaaataaaaagaatataatttataataacatcaatataaaatatttaagggtaaatattaaaaaatggaaagtcttaaactgaaaactataaaacgttgagagtcattacaaaaaaaccttaaaataactgatattccttgtttgtagttggaaaactcaatgtgattataatttttataatgacaattctttccaaagttatctaaggaatcattgtaaggtcttcagtaaaaataggtttgcagggaatgaggagataaaaaaatctcaacaaagaaatgaaaactgtaacagaaaacatcaatgaaacaacagacctgggataatccttctcagctgccatgggatctaactgtatttaagaaaggggtgagtaggaaggcggctgccaaatccaggaacacagatgtcattttgagtgaccaaggtgagccaagggaggacagctttagtcagaagagcatagaccaggagcagaactcacatatctgaagctgatgggcagagtgtgggtgcaataggcctggcattgggtgctgctgagctgaaattatgctgtcacctgaggtgcgcccctggggtgacatggttctggttgttcttcaccccagggaaggacactgtgacctgttatctgttggaggatgaggactcagaaagctctttataagagagggcaccagtgtgatatgagggtccctgattgtctttccaaaggttggaaattgaacccgcatctttcatttttgtgtagagaacccaagatccttttctacataatcaagggttatttccaatagctgccttggcctgtctcagaaagagtgtgggtttgtcttacagcaatggtgcccactatttatgggaacgtcttgtataccctgatctatgctttcaggtctttgacatctcaggtttttggcctacctaatactagccatacgtctgggtactgtgatctacctcctactacacatataaatgcccatctcagcctcatctctccttgggatataaatgtgtgcaagggatttgaagcagctctgccttctttttgggtcctaaggatcagggttatgggtgtctccatccttccctgggtcttctcctcctcactgtcctgaaacatgacccagacacaggctcctgaggctcctgcaggccttcttccctgcttttgccaactgcaggtggaccctgccctgtgctcacaggtctttgtatctctccctgctggtcaattgccctgcaggggcttttcttatttctccattatgagaattcctttgtttttggaggaaataatttttatctaatttttgatttacttatcataatcctagaatttgtataaaaactcctgtttttgcataatgaaacagttgctatctcatgccattttattcaaagtcatgtgcttctgttcacttactggttagaactattgtttaatcattgacaaatatttatcgaacacccactctgcgccatgttctcctatgtcaggtgctgggtatacattgatgaatgaaacagactctatccttatggaacttgtgtctagtgagcttagaagtaaattttgtgagtgctaggatggagagtcaagctaaggactcttagttctgccagcatttaacatgttgttcttatacattttaagaataaattactccagaagaatctttttgttttgttttgttttgttttgttttggtgaagagtatccacatagacacacatagcaaagaccttatagaatgcatcagagataaacaaaataaaatgtaatgtttcccagagctggatgtagtttctggtttgatttattttaatgacacacagaagaaatcactttataatgaagtaaaattccacactacagaaacagagtaaaaatactttcttgaaaaaaatgccaaacctacctttaatcccaaggaaagagaattgcttgaatagatctgttagtatgaaacacataatagacaacctgctgtgtaaaattacttggaagtcatattttagaaggttttaaacattcttaatatactctgtttttgatattacgtcttatatttttctctgtggtggaaatttatttctaagaaataagaaaggatattagaatggcaaaaaatatttgtataaatgtgttaacattttaatggtaactatatatgaataaaataaaaacattgttaaaaatttattggaatgaataataaaattatcaagtttataattaataaaatcaagtatatttcttcttatgcaatttaaaaatagtgcagaatgtttattattctggtatcactaaaaatgacaaacttcattcatatctatagaaaaataattataaaattcagcaagtaatacaggagataatttgaacaaatattgaaacattttcttacttaaagacactaggtaaaaatttcagcaatgagtagagaggttatcaaggcgcattttattattgatgattgatatatgttttttctctcgagaaagtgcacaggtgggtatcagcagaggagacagtataggctccccagatgtcaaagcagggatgcgccaatacccatcagtcatcatcataaaagacagactgtgccttcctgtgtcaggctctgtgccaggagctgtgtgccccacgttcccttccagggtcctgcctgaagtctgtgctcactcagccagccccatcatctggaagtaacagtcccctcctcctgcactggaataagcagaagatttgggtggacagtgtggcctggccccatcagctcccaggagaagctctctgtctctctctcatcctgcatgccagttaatgacgataaaacccacctaaccaacccatctacaacactcagcttcatccctatctctctctcacactccatcaagggacacagtcatcccatgggttttttcccctggcatctctcactttcttcctcttccagatccctgggatcagctatcaccccacccgacaccccttctcctgcttggctgccttcaggctctttgttgagcctgacaccaaaggatgtctttctaaagtgtcagtttcatctattctgcccccagttcacaacctgaaacaacctccgatagtgaatcaagccaagcccctcactctaaagcacagagacatgccatgaattcctaaggggatgacagaatacatcattgatgagaagattgaacaagtgaagtgtgagtggcaagtcaggtgaggacatttgaatccaatctggcatttaaaatgtctcttcatttccaaagtcctatctctccctagtaatgttgtttgactgctagtcccagagcaggaccccacatcccagtgacagccaagtcacagtcgcctccttccctggcccctgtggaaagagctgctcagggctttgctcccagagccctctgcattcccaacttcctgcagcctcctttcattggatgggggtgatagtttgcacatgcctttctagtaatccaagaaaaacttactgaaaaagtctgtttgttcatgtcagtaatcaggggcatgaccagggcatggcccataaatgcctctggactgatactcaccaggctcccaggccaacaccacatacatgatttccactgagagaatgcagtctggacagagagcagcagggtacactgtaggtctgcccagtgggcatccacagctgtgccaacccctcccaccccacaaattcctcagggctgggcagtggaccctgccctcactgagcctgactcagcagctctgtcctccctgggtgtggtcccagcacccacttcctcccaggtctggcctgccagactcccccctccaccagaccctaggacttgaataaatacatagggtaaggtagaggcaggcaatgtgggggacacatttgggtccataactcctcctctgtgaggtcagtggaggggataagaggcctgaggcagcccactatggctgtggacctcaggaggactgtgttgaccatggcctgggcccctctcctgctgtttctctctcaattctcaggtaggcacaggcctcccatgtccagggcatgtccctcaggcttcaccagtcccctctggctaaaatcttacagcaactttatgctggtaggtggcccaactcccatgtgcatctgtgtctgcaggttccctctcccagcctgtgctgactcagccgccctccctctctgcacctccggatcagccagactctcctgcaccctgagcagtggcttcagtgctgatttctgctggatatactggtaccagcataaaccagggagcctccccagtatctcctgagccactaccaaaattcacttcatgaccagggctccggggtccccaggcacttctctggattaatggaaggccggtccaataaagggctcttgctcatatctgatctccagtctgaggatgaggcttactattactgtatgatcgagcacagcagagcttctcatgctgacacacacaggtggggaagtgggacaaaatctcagcctgctcagagtcttgttctctgatgaaatttagatcttaaaataacttatatcacttgtgtgggatgagtgagatatcccgagctcacaggaactgtcgatgaaaagagtcgagctctgtaaaatattgaagacatttattccaagccaaatatcagtgaccaatggcccacaacgcagccctcaggagatcctgagaacatgtaccccaggtggtcaggctgcaacttggttttatacattttaaggagacatgagacatcaatcaacacatgcgagatgtacgttggttgagtccaggaaggcagcacaactcaaagtagtggggctccaaagatcgtctttttgataattggttaaaagagttaaattattgtctaaagacttagaaccaaaggaatgcctgggttaaattaaggcattgtagtgaccaaggttttgttgctcagaggaagcctccaggtagcaggctgcagagaaaatagattgtaaatctttcttatcagatgtaaaaagtctgttctctcagaaattccaaaaatgaggaggcatatctggctccccgttcccatgatgacctgaactctctttcagattaactttggaatgcccttggccaaaaggaggggtctgttcagatggatgggagtcttagaattttatttttggtttacaatcctgtaacacgtcctgtaatttgctgcccagaggtcattaatggcctggaagaaataatgtgccagctgcagtgttgtccacagaaagacttactcattctgctgccctgagtagtgatatcagaaagatccatctgccaacagtcagaatacccttccaggagggttgcacagtaccaggggtgctggaagacctgggatctgaggcaagcagggggcactgttggatggatcccaagatgacaggattaccaggccacacaaggattaaacaagagacagtaacagtccactggctcttacacacttggataagcagtgacctccctgaagaatgactttcctgcacctgggctgaaggacccacatgagcactgggttttggataaaatagagcaatttcatttatgaacatagatgtgaaaattcctcagcatattcacaagtagaacccatgctggacctctgacctctaggatttaggctgagaacaggacatttgtgaggtcggtggggaataagcatgaactttggagggacagcaggtatgaggggtgctgagccgtatgttagatgccccaatcagggaaagagcctcgaggcttccagtgcagcttccctgataccctgtgggagagaaagatagatactggatatgctgcaatagagctcactaatgctctagtaaagagcaggcagcttgcattagcacagtccttcaggagagaaaacgcagccccaggaaagctgtcagaggccaagatgactcattagtcacattgaattcataatgcatttatgatgaaatatatgataaatgtcttatccttttgttcttttttattttttattatcgtgggtacataataggtgtatatatttatggggttatgagatgttttgatacaggcatgcaatgtgaaataattatatcatgaagaatggggtatccatcctctcaagcatttatcatttgtgttacaaatgatccaattacactctttacataattcaaaaaagtacaattaaattattatgaccataggtatcctgttgtgctatgaaatagtaggtactattcattctttctaactactttttgtacccattaaccatccccacatcacctcctactccctgctaccttcccagcctctggtaaccattattctactttctatgtacatgagtttcaaatgttttgatttttagattccataaaaaagtgagaatatgtgatgtttgcctttctgggcctggcttattacacttaatataatgatctccagttccatccctgttgttgcaaatgacagactcttattctattttatggctgaatagtactccatcgtgtgtatttaccacattttttatgcattcatctgttgatggacacttagattgcttccaaatcttagctaaacagtgctgcagcaaacataggagtgcagctatttctctgatatactgattttctttattttggatatgtatccagcagtgaaattgctggatcatatggtagccctatttttaggttttttgaggaacctccaatcgttctccatagtggctgtactaaatccaagaacattcaaaatcatatttatatcagtgctaaaaagtgtgacttgacttcaaacaatagccagtagttggtaggaatacaagtataagtttgctaaaaatatgatttgtcatttatatgaatatttctgttcccagaacaatctcatgtagactggcttctggaatctctcctacctcctactgagctgactctcctggagcctggccgtaacggtgcagggctggaagctatatactacaagcacatgctgtatggcatccagcactaacctgggcagatgacggcgaaacaatgtgtgatatttccatttgatttattttccttctttctctatagaaagtgttattataaaactgttatgttgaaggaacacaaaatttgaaggaaaggaatcaaacataaatgttaaatgtttatgtgtgtttatactgttgatctatgatatctcttgtagttactgttcaacatttctattttatatgcttttgtaaaataaacaacatattttatacaaaaactctcatgtgtgctagttgaaagtaatgccacctaaatgcaataacagaatttgaggagactaaaatgtgttgatttgagagacagtaagagtaatttagaacaagtccccatctggctctgaaatctaatcctttgctggtatccctacacctgaaaacctgcaggctttgcacctctgcagacagatgacattgggttaaattcatgggtctccactgagggtcacaataggctggtgtggcacagtgcattctgggagatacagaactgagggacagtaggctgggcgcggtggctcacacctgtaatcccagcactttggcaggccgaggcgggcagaacacgaggtcaggagatcgagaccatcctggctaacacggtgagaccctgtctctactaaaaatacaaaaaattagcctgacgtggttggggggcacctgtagtcccagctacttgggaggctgaggcaggagaatagcatgaacctgggaggaagaggttgcagtgagccgagattgtgccactgcacttcagcctgggcgacagagcaagactctgtctcaaaaaaacaaaaacagacaaacaaacaaagaactgagggacagtatatccccagtggacaccgatccataatcagccccagtcactgcacagactgggtgtatggtgtcctcagtgcctgctgcttccgtgtaaatgaacagcaggagatcctagggtattagtgaattatatattcatttccaacgtcacactcaagatgaagtctctacagtatttgaaattgaacttggacagcttcaactatttttgtttcaaaaaatattatatatacaaaaataccctatttctgaaggtaattggagtttattttacttccacaataatactaaacataaatggttagcgtattataaagtggtgtgtctaggcatggacagcagaaggcacttggagcctgttcctgaggggtctgggggtgttcggagctgagaccagccacttcccctgtctggtgctctctgttcagggctcacagctgtgatctcctcacccctgaacggctcacagcactactcatacttatccctatggcgccctcaggcagaagagtctgatccagggctcagggtgggatcagaaaagttcccatttgcatgaggagatcctccctgcctcagagtataaagagagaaaaggagagagttgggaaaagctttacttcaactgtggggcaaaaaggcaggactcaggacaatctcaagaatggcctggtcccatttcctgctcaccccctttattcactgcacaggtgactggacatggggccacggaaggggccctggggagcccatggagagctgctttctcctcttatttatagacccagaatcaccatgtctgtgtctttcccactttcagggccttgggtcccatctgcgctgattcagtcaccctcagtccctggggctctgggccagagggtcaccatctcctgcactggaagcagctccactttggttattggtgtgatatacactggttccagcagctccaaggaatgacccccaaactcctcatctataaaaacaattggtgacacctgtgggtccctgacaattctctggcttcaagtctggcaactccattttcgtgaccatcactgtgctacagcctgaagatgaggctgattatcactgccaattctacaaaaacagcctgagtgctttcacagtgctccgggttgaagtaagtcagaccaaaacacacagtgtgcccagccatgaagctctcccatgcaccccctactctgcagctaagtcaatgtgttctctcacttgtttgtcctaaaactggggcctgagaacttcttcagggtaatttttctagggaatgtgtcctcaccctctcaatatctgccccaaattcactctttggcaacaataccatgtgctcttttctcagaggtagcagctggtactgaatgccagaggccagctgccctgtggtggagtacagatgggtgaatcagtcggctggggcttccacaacaacacaccacagactggagtcttcaccaacagatatgtattgtcttactgttctggagtctgaaaggaccagatgaaggtgccaccccgtttggttttctctttgccctctttcctttgcttccagatggctcttttctcactgtgtcctcacatggccacccccaggtctgcatgtggtttttgtacacatttcttatgaagtctttagtccttttggattagagactcattcctatgacttcattgaatcttaataatcttagtgtccagatctcccaatacagacaaattggtaacttagttataacataaaaaatcagggggccaggctcggtggctcacttctgttaatcccagcactttgggaggctgaggtgggtggatcacgaggtcaggagattgagaccatcctggctaacacggtgaaactccatctttactaaaaatacaaaaaattagctgagcatggtggtacatgcctgtagtcccagctactcaggaggctgaggcaggagaatcactggaaccaggaggtagaggctgcagtgagccaagatcacccactgcactccagcctgtgtgacagagcaagactccatctcaaaaaaaaaaaaaaaaattcggggtggatgcaatataatttgtaacaaaggatcaggggtccagggacccagagtccatctgtgtctgacccaggagaggtgatgctgcagaggccacctggtcactccattcctctgagctcctactatgtgcagattctggatgtgttcttggtgctcagggtacagcgtggataagacaggatggtccctgtcctccaggaactgatgctatttaggggaaaacagaacacatcagtaaatgtatcaataagaatatgacatgttttaggaaaatgaagagaggtgtgttttggtgaggtggggtgagcagacttagaggagttgatgacaaagatgcagcgactgattaaggttgtaaaattcacctgctgcaacataaagtgaactaagaggaagtgagggtccaggcagggccatatgaggctctggttttgacacaaacattaggctgtggagtcctggacatgggcggaacacgcaaacggtgaaaggtcatgtctgcatggttcagaagtgggaggtgctgaggaatggagtgtggggagacagggaccacagctgggatctcaggacctgtgaggggtataggtgagctgcagctaagtgagaaaacattaaggaccctgtgtagttgacacaagattattgacatcttaagtcttcaataaatacaatcagcgctgacaaatgtggccgtgcctcagaagagctagaaatgtttatgtctaggtaactctcatgttctgtagaacttcacttgtatttttttggttttaaaggattattataagagcagacgtttatgaatatactccattcttttatcctcaatattgcccatctcttaaaatcctttggctttacacacacctacaacaaactgatcttcaaaaattgataaaaataaacgatgtgtaaaggataccctattcaataaatgatgctgagaaaactggcctacaatgcagaaaagtaaaactggacccctacctcttaccatataaaaaattaattccagatgaatgaagacttaaatgtaagacctccaactattaaaatcttagaagaaaagttggaaaatactcttgtggacattggtgtgggcaaataatgtatgtctaatcatcaaaagaaattgcaacaaaaaacttgacaatcaggaccaaataaaactaaggagctcctgcatggcaaaagaaactctcatcagagtaaacagacagcctacgcaatgggaaaaatatttgcaaactatgcatctaacaaaggactaatatccagaatctataagaaagctaagtcaacaaaaaaatttaactccattaaaaagtggacaaaggacatggtcacttctcaaaagaagacaaaaaagcagccagcaaacatgaaaacatgcagaacttcacttatcagagaggtgcaaatcaaaaccacatgggatatcatctcataccagtgagaatgggtattattaaaaagtctaaaaataacagatgctggcaagaatacagaaaaaaaggaatgcttatacattgttggtggggatgtaaattagtacagcttctgtggaaagcagtttggagatttctcaaaaaaaaaaaaaaaaaaaaaaaactaccactggacccaggaatctaggtgtgtacacagaagaatataaataattctaccaaaaagatatctgaactcattcgtttgttgcagcagtattcacaatagcaataacatggaatcaactcaagtgctcattagtagtggatcgagtaaaaataaaatgtgtgatacgcattcaccatggaatactatgcagccattgtgaacaacaaaaccatgttctttgcaaaatatggatgtagctgaaagctactttgcttccagatggctctcttctcactgtgtcctcacgtggtcactctcaggtctgtgtgttgtttttgtacagattgcttatgaagtcattagtcctcttggattagagactcattcttatgacctcattgtatcttaattatcttagtgtccagatctcccaatacagataaattgttaattcagttataacgtgaaaattcagggtgaacacaatataatttgtaacaaaggatcagggatctctttggcttctcgatggatcacctgccaaggggcaagggtgtaatttttacaatgataggcgcatagctcttaacacaagacagaattaccctgttgaatgcttcattcaaatgatatgttagggaggaggccagttggatgataaagctttgggaatgaacatttaacagcacaggatctaaaatgcagaagaaaagaacctctgatgcaaactttctgagtggagataaactgtctgatatcctgcagattaataaaaccagaaacttcatctgccccctctaatagaaatctacacattaacacaatttcactatatgaagtttccagaagatgatgtggagcttgcaggtgagcttcattttacactttccgcctattcatttctgtgggaggacttactttccctctttcaattttctcatgtgctgttcatgtcacaccctctaattcaaggctccagcccacctttcctgccaacaccaacactctctgtagatgaaaacccaccagtcagcagcctccttggcctgagagaggtcatcttcctgggtttctaagactctggtcctgccgagattctccttcctcaatcctaatcccgtggtctctggcagccccttcacatggacctcatcgctcgtctctgtgttcctccagctatatccacgtcagaaactgctcttcatctgcactagaaataaagaattatcctctcaactcttaaatgtttgctctgattctctcctcttctttgagctcaggcacaccaccccctctcagattcctgagtgtggcagtgtcccctctccagtctccctaccacctccaatggtgaaggcgaagaaaggatgtccctgcatgtatcacatcctcatccttcccttcagggtcagctccctgggtagggaaaacactgttcccttgaggctcacatacccactgtcaaaaagcacccagcacatggtaggcactcaataaacctttaccaaatgcagacctgcctctcaccacactggacacattgtagtgagctcaggatggggctaaactgggagtattagctgtaaacttgctcctctctctgtccccagcctgagagctgagggggcacccacgagggagagcacctaggggcagggaggggtcacaggcagcctcatcctctgtgtgagacactgctcagactgggggatccctcttcattcagatgggaagaaaagggaaacaaaattcggtaggaacttctatgcatccacacagaggaggcaatgacaagaaaacacaggatgcaagcacagtggtaataatgtatttctacctaatattgaataaaactcaatattgcctgtattctgtaaacaataactatttacaaaactgactgtaaattatgattttaaaaaccacagcttatgaagaagagaaacctcaaacaatgacacccctgaattgcaaatctaagacatggcacacatttattttcagttccatatgtggcctggatttatttacaagacaatattatgatattatatgtcactattccattttagatggtgtatttaaaatctcacagtactgcaactacctagtaatctactcatcagtataaacatcaatgtgacaatcctgctatccttctctacccctgcataaccccagcaaaaattcattatgaattcacagaatgtaatatcagaactgttgtagccacatacacagtttgtttcattttatgttttgataaagtaatcttttttgtttaagcttattgttttttaaaaaatatattacatactagatgtcattacaaatcagagattaataatttctcttatgcttatactactcccacagcactcattactgaatgtaaaccatatttatattttctttctttttttttttttgagacagggactcactctatcacccaggctggagtgcagtcgcacaatctcggctcattgtaacctccacctcccaagtttaattgattctcctgcctcagcattctgagtagctggcattacaggcacccgccaccatgcccagctaatttttgtatttttagtagcgatggggtttcaccatgttggccaggctggtctcgaactcctgacctcaagtgatctgcctgcctcagcctcccaaagtgctgagattacaggcttgagccacctgcctggctccatatttatattttctaaacatcctacttggagtggctgatcctaccagctaccatgtttccacctcacctgggatcaaacactgacaattggtaattttatctcttgcagtcttcaaatattgagcaaatttgccatttttgctattcaataaaaatgctggaaagttatttgccatgccactgactctgttcagtgcttggaggacagactcctaggagtgagaagttgaccacagcatctgaatagctattaccccaagtctgtggaaattagagaacaaaattttaccagaaatgccccccagagcttctccccataacctcaccacccttagagaagagagctcctgttctcctcagcgctgcagggtccacagaggaggaagagctctggccagcagggaggagccacagaagaaaggacctggtgtctcccgtgaccagggtagtgagtcatgggaaccagtcactgctctggacttgacctgacctaagaggacttggtatagagtcaccacttcagtcctcaccaaggaacatccaaaaagccctggacagattcacccttaaggagaccagtaaagcatgaactgccctgagttaatgagaaggtcacaaaaagggtctgtctggcctggtgctgagcctgggggcagtgatcagagcagggggaatgcacagctggctctggggacatctggtcatcatgtcacaggagagtgtgtctggatgtggacacctggggacatgaagggctcattaccaagtgatctaggggagatcagagctgcgatcagctaactgcctgcatggtgccctctgctcagtgatcacagtggtgagctcctgatgccccggaacacacagtttcacccttgcctgtatccctgatatccacgagaggggcctgacccaaggccagcgtgtcatcagaaggctggggggctctaatttgcatggatggaccctcattctcagagaatgaagaggggaagggagagatttggggaagctctgtctcagctgtgggcacagaaggaaggcaggactcaggacaatctccagcatggtctggtttcctctcctcctcactctccttgcacactgcacaggtgactagatataaggccatggctaaagccctaggaagcccatgggccctgctttctccttttgtctctcaacccagaatcaccatgactgtttctctcccacttccaggatcctgggctcagtctgtgctgactcagccaccctcagtgtcttgggccacaaggcagaggctcactgtctcctgcactggaagcagctccaacactgggactggctataacgtaaactgttggcagtagctcccaagaactgaccccaaactcctcaggcatggtgataagaattgggcctcctgggtatctgaccaattctctggttccaagtctggcagcttggcctccctgggcaccactgggctctgggctgaggacaagactgattatcactgccagtcccgtgacatctgctgagtgcttgtacagtgctccaggcttgcaggggagtgagacaagaacccccttcctcctttcccaggagggtgagtgcccagcagctactgcacaggcctggcctgtggcttctgcagttgctgtttccccagtgggcctgggagcatccagggccccacctgggagtagatgcttctcctcccctccgtcctcagagtcacccacagcagtccctttctaggaaaagggcctccagaaaacagaatgtcctgtaccctgcaacttgggacacagggtctctgctctaaagtccaggggctggagtgacaaatccagcagtgaaatctcagatctacatctgatggggaacctgcatctccatcatccttttgctatttccaggagttttcaaagcagtgtcttcctctcactggtcctcagtgtgttttcctgttctttttgtttcagcctatttttttttttttttttgagatggagtctcgctctgtcgcccaggctggagcgcagtggcgcgatcttggctcactgcaaactccgcctcccgggttcacgccattctcctgcctcagcctcccgagtagctgggactacaggcgcccgccaccatgcccggctaattttttgtatttttagtagggatggggtttcaccattcacaggattgtctcgatctcctgaccttaagtgatccgcccacctcggcctcccaaagtgctgggattacaggcgtgagccaccatgccgggtctgtttcagcctattttttatgtgtctttttattgaggaataattaacaaaataaacccctgatatttaaagtgcccaattttgtgtgttttaagatatttatacacccttggataatcaccacaatgaatcagtgattccatcagaagaaatcggtgactggttctggcagaatccagggaaccctatctaatatctcgtgaacttctacttggactcaagtaagaaacagggctctgaggctcccagccacatcttgggatctaaagatgcgtcggcctgtgcaaggattttgcacgttgctgtgctgcagcctgagaatgggtctgtctcggggtctgcacaggggcagtggatttcacagtggctctgaggcttacacagggctccaggcccatgggaaagtgagacacaaatcttccctctgctctctaggcctggtgcagtgatcctggctggaggctctgataaatctagctcagaatgtaacttctgttgtgaacatctgattttccttggacaaatagttctgacaatatcttatttcagttcgactagtatatcgatccattgctcatacttctcattccattcttgctttcgcaatcggtggaccctgtcctgtgcccacagttctctgcatctctccctgctagtccagcctcctgcaaaggttcagctcccagaagagactcctacatccactgccctggaagaagcaacactatgagtagaatggcaagattttgtcacatcagcactggggataactcatcactactctgggcccattgaagcaatcacatactctctgaacctcagttttcatttttggcagcatgtaaccctacctcagcagctcttgctttcaacatggggatgagctgaagaagaggcttgtaaatgacaagtatcagtcactgttcaccgtgcaggggtgtctgtgtccttctgtgtcaggctttgtgccagcagggctgtgccccgcaaactcttccaaggtcctccatgcagtctgtgttccctcatctggccacattgtctggaagttaaggtcacctcctcatgcactggaacaagcagcagagtcgagtggacagcgtggcctggcaccgccagctcctacgggagccccagatggtaatgcctgctggtctccagcttgcagggttctgattttgggctcttgctctaggtctggccacttgggcttctgcaatactctgggatcctgtatgaggatgagggtgatgatcagtgttcaggatgtggaaagagccccaggttaacccaggacacctgtctcatggggacatgaggcacaagcctcccatctgatcccacagcctggcctatagactcactttaattttgtgtgactgtcacctgactcaggacattcctgcagtcattttttcctccaggactgatggaatgaggccattccctgggtctgtcgcctcatatgcagtcgacctatatactgggctttcaggataaaacattcccagcctgggcattgcaatacagacaggcaggtagctcagacagaaaatactcttgttgattccagatttctgggcacatggacttggtgtgtgtttgtgtccatgactaaggtcaggtttggggttgggagtgagagtggtcaccacatggtccaggaagaatgtgttgtcaaagataaaattcgtacaccttcctgcccttccctgtacctgaggcagcttcctgaagcctgcaggtttctgagattctccataaatggagaggaaacatcccatagaatggatgggttttttttgtcccagacaaaaagacaagacaggacgagggtacagatgtcagcaagggttaaacagcaagtatgcacttgatcatgccaaagaatactgaaatagctttgagggtaattcagtgtccttgagaattaaaaacaaattggagattgagggcttcaaacccccattaggtccttgtgcaaacagatgctgaattccaacccacattaagaaagaggctaaaaagatgagacaaaatctctgaaagacaggtggaggggatttctgcagtttcttggtgcttaagagacagggacctgccaggcactcacctgagaaatcctgcagggtcacagcacagggaagggaatgtgtcgggtacataagatgactttgatgttgaaaacaccacctctaccactgataatggttttcatcattcatacttaggtgcatgtacaacctctagcaaccataattaccacaaaggacaggcattgtgtaaacttttatgaggttctgtgttataaaataattacacaaaatgtataaataatgtgggcactaataaggtgaggttatatgttgcaatatctggggttcctattgaatttatagactgtaaaactaaataggtgctaatgtaaaatgatacagttagaaatacttgattcatgaaaaataaaaagtgagcgaaaagaaataaagcaaaaagcccaaataaaataaagagaaaggtaaactcacacacaatatcagcaattatattcaatgtaaatgtgttgatgaaccagataaaaataatttccttaaaataaagttacttgtgtgttatattttaaaggatgctaaaaatacactatgcaaacatttacctgcagaaagctcttgtggttatctcggtatcagaccagataatttcaatgaaaattatttacatcaggaaatgtgggacattttatgtatataaaatgaaatatttgacaagaacacataacaattataaaatacacatcagtccatgcatggtggctcacgcctgtaatcccagccctttgggaggccaaggtgggtggattgcttgagctcaggagttctagaccagcctgggcagcatggcaaaatttcatctctaaaaagtacagaaaaaaaaattagccaggcacggtggcatatgtgtctgtagtcccagatacttgggagcctgaggtaggaggatcccttgagcctgagaggtggaggttgcagtgagccaagatagcgccactgcactcctgccagggtgacagagtgagatcccatctcaaacaacaacaaacaaacaaacgaacaaaacaaaccaaaaaagcacacacaaataaacaaaccaaaaaacatgtccctaataatataatctatataaaatataaattagcaggactaaggaagagaaaagaatcaattcccaattatagttataaataatagcacacacttctattaactgagtgaatcagcagaaaaaaaattgcacataacaatatgtgaacaacctgaaaaaccaaattcacccactgacgccaggagcccaaacctgaggagtagttggctaatgaatatgtattactgaaacgattgaataagtgctagaagaaataaatgaggcattcattatttttacccgatttgatgcttctcctctctgtcctgtgagcagggggcactcccatgtctattcctagtcccattcttatcccctcgtctctctccccaagactgagctgcattctgcagggtggctcccgtccccctggagtaaatgactgacgtgaggagccctgccttccagtgctgctgttttcatcgtgctctggtttgaatgtctcccttccaaaaggatttatacttaattgccagtgtgatagtactaagaggtaggccttcaaaaggtgatatagtcttgaacacggagacctcacggttgggatcaggtctcttatataaaggctggaggtagcggtgtgctctgtctctcttcttgccatgtgaggacacagaaaaaaggcacttatcagatgacagtgccttgatcctgaacttcccagcctcaaaaactgtgagaaggccaggtgcggtggctcatgcctgtaatccaagcactttgggaggccaaagcaggtgaatcccttgagtccaggagttcgagaccagcctgagcaacatggtaaaaccccatttctataaaaaatacaaaaattagccagatgcagtgacaggcacttgtagtcctacctaatcaggaggctgaggtgggaggatcacctgagcctgggaggtcgaggctgcagtgagttgtgattgtgccactgtactccagcctggatgacagagcgggagactgtctcaaaaaattaaaaaataaataaataaaaaataaaacagtgggcgagataaagaaaatgtgttacttatataccacggaacactatgcagccataaaagaaagttatgttcttggcagcaacgtggatggagctggaggccattatcataagtgaactaagccccgaacagaaaaccaaatgctgcatgatctcacttataagtgggagctaaactatgaatatacccgaacatacggaaaggaacaacagacactgggaatgactaccagaccaaaaaaaaaaaaaaaaaaaaagaggatccaccctgtggatcctctgcccactgcctgggtcatgaggttgttgggaccccaagcctccgtgtcatgcaatcaacagatgtaactaacctgcatgtgtaccctttaaactagaatagtaagagtaaagagcattgaaagaaaaagtcaagatcagaagcgaagaaaataataaatgaaaaaacacaatctatagttatccaaacaatccatgactgtcacaaacacagaacaaggacccagtggacagaatgaggcagccaaatactcaacccaacatgatacatagggaacacatttttcaaaacaccaaaaagacacaatgggaaagggagagtctggttcaagaagtgattttgagaaaactgaatatgcacatgcaaaacactgaaataagacctttgcattgcacgatacacaaaatcaacacaaaataaattaaagacctaaactcaatcttgaaactgcaaaggtcttataagaaaacataggttgggtgtatattttaggaagcctgtatctatgcacacaggctgcaaaaggtgaaaaataatcataacactaaagggaaaattaggggaactacatgcacagacaatgcaatggcttggctatatatgtgtgtgtgtatgtgtgtgtgttttgtagggtggaggtttggatacaaaaattacagctaacatgcaaatataaacaaagacactagtgacactttagaacttctacagggggaaagaaacaatgaaataaacaaacaaacaaaatgcatcctaaagactaggagagaattatggaaagtcctacctctgaaagagattgttatctaacacctacaataaactcactctactaaatgaaaaacaacaaaaacaacaacaacaaatacccaagctaagaggatctgaatagacatgtgtgtaaagaagacaggaaattgactcacaggttaacagtttctcaatatcactaatcctcacaaaaaagtgaatcaaaaccatactcaggtaccatataattccagttaaaatgaatattgcaaaagataaaaataaaaattgttggaggtgatggctggtgtagaattgcaggaaggaaaactgttgtacgctctttgtgggaatgtaaattagtatacacactatgcaaaactgttggaggttccttaaaaaagtaaaaggtcaaagtacaaccaccactccaggttaacaatcccaccactgggtacacatttagaggaaacaaaatccctgcattgaagaggtatctgccttcccatgtgtcctgaagcactagtcacaatagtcaagatatggaatcaacctaactgtccatccacagatgaagagataaaggaactggatatatacatgatggaaagcatttcagccataacagtttgggaaatcattgatctgcagccatgtggagaaacctggaagacaattaggggaaatgaaatgagcctgttagagagagacccatactgcatgacattaggcaaatggaatccaaaaaacactgtcttctagaagcagaactttcaataggggttactagaagctggagagaggagggggcctgggcagggattggtaatgggtacagagtaacactcagaggagaggaatccattctgatgttctattccacagcagggtgaccagggtcaacaatgtctaggggaatttttcaaaaacagctggaaaggatggttctgaatgttctctccacagggaaataataagaagccagacaccatgatttgatcatgacactacgtatacatatatcaaaatgtcccttgcaccctctggttatatacatacactctatagtaatgaaactgccatcaaatgttggtagtattcattctaactggagtgacatagaatctgagtgtggttttcaatcatgttttggtgtgaatcggccatgttgataatcttatcttttacctgtgcatcaacctcatgtcttcaggtcctctgcccacttttacacatcaaattcaaaacaaattaacaataacatggcaaatataactaatcacacacacacagaaaatgaaaaccaccactcagattccatctcactctagatggaatggatactacaaaaaaaaagttgaaaaatattaaaagacaaaaaaacgatggtgtggatttccagagggggaacttgtctccgcagttcgtaggaacataaactagtacacacactaaagaaaccacttggaggtccctccaaaccttaaaaccacaactaccatttcatccagcaatctactactagtcgtatatacagagtacatgaaatcaagccatggaagagattatctgcgttcccaggtggaatccagcactatgcagaatggccaagatgagaaatcagccgacctgtccatctgcagatgaagggataaggaaactgtcccatgcgtagacactggaatactcttcagccagaaaaatacaatgaattcccatcacgggagccacacggttgcacctggaggacatgatggtaaatgaaatgagccaggcagagacagacaaactttgcatcctctcactcatgcagaagctgagaaactttatctcaaagacctagaaagcataatcatggttaccagaggttggggggaagaaggggaaggggcaaggattggaaaggggtagaaagttccacacagatgagaggaaggaaattctgtttttctattccacagcagggtgactagggttaatagcatcattacatcttcaaaacagcttgaaaggaggatactgaagcttctcgccacaaaagaataaacagtggtacgaaataacagaaaaaataaataccctgatttcgtcattccacaatgtatgcaaagaccaaaatgtcgcactctaccctctcattgcattcctttactattcagcaaatttgtttaaagaaatataaatacatgatgctagaattcacatgggaccatgaatcaccctgaatttcttccaaagcaatcctgagacattcagactacatcagatgcatctcacccaccgatttcaaatttcatggaaaaactgggtacctgcttccacacagagcagtggaacacaagagagggcccagaagtaaactcacacaccaaaaaccatctgatccttgacagaatccacaacaataagcaagggggaaaggatgccctattcaaacaatggtgctgggataagtggttagccatatgcggaagagtaacactgggccccgacctctaaccagacacaaaaagaaactccagatgaatgaaagatttaaatggaagacctcaaactattaaaatcctgcaagaaaacatacaaaatacctttctccacacaggttttggcaaagaatctatttggctatgtccccaaaggaaatgacaacaaaaatggacaagccatgcttaatactctaaagagccaccacacagcaaaataaattagcaacagagtaagagacagcatacagagtgggagaacatgttcccaaactgcatctgatcaaggtctaatatccagaatcttcaaggatcttatgccaatcattcaacaaaaaacaacaaaaaaatcccattagtgtatgggcaagggatgtgaacacacacttctcataggacaatgtgcaagtgaccaacaaagagggaaacatgctcaaactcactcatcaacagagaaatgccaatcaagagcaggtcgagataccatcccacaccactcagagcggcgatgactatgcagacaaagaaagaaagaaagatactggcgaggcagctgaggagaggaaaggctgatatggtcttggtgggggaagcaagctagtacagacactgtggaaagaagtttggagatttctcaaagaacttagaactaccatccaaccccacaatccctctcctgaagatctacccaaggaaaatatatccttctatccaaaagacacaggcacttgtatgctcacggccgtgttattcacaatggtaaagaaacggaatcaacctaggcatccatcaacagtggataagataaagaaaatatggtatgtatacaccacaaaacactacacagcccccaaaaatcacatttttggcagcaacatggatggagctgcaggtcattatcctaagtgaactcaaggccagaacagaaatccaaatgccacacattctcacttataagtgggaactaaactatgaatgcacctgaacgtaaagaagggaatgattacattaggaataactaccagaccaaaaagaaaatgcaaatgggagggagggggcgttgcgtcctgaagacccaccttgtgcgtcctctgctcactgcccgggtcatggagttgttgggagcccaagcctcagtattatgcaaccaacagatataattaacctgtgtgtgtactctttcatctataataaaagtagaaactattacacacacacacacacacacacacacacacacgaagaagcttaagagctacataaacaaaaaaataagtaaaatctatagttatccaaacaatccctcactggcaaacacacagaaacactaacctatggacaaaatgagaaagccaaaaatgcagcccaaaattacatatggtgaatgcatttttcaagagaacaccaaatatcacaacagtgaagagagaagtctgctaattgtctttgagtaaaatgaatttctacctgcaaaacactgaaatggatcctcatgttacataagacaaaaaaatcaatgcaaaatacagtaaagatctccacccaaaactgaaaacacagggtgttttcacaccctagaagaaaacacagggtgagcgtttacttcagtgaaactttaatctatgtacacagattgccaaaaggaaagaaaacaaaagggaaaagtaggaggaagaaacccacagacaatgcgatcttttttcctttttttttgtgacgggacaccaaagtcaccacatgcacatgcaaatagaaacacgcaggactatggaaagctttagagatgttccacaggaatgaaaccaatgaaccgaaagagaaggtgtcctacagatttggagacagatctgaaaaactgtatctctgaaagcggttgttatctaacatgtccaagaaactaacaccactgtgtttggaagcaacaacaacaacaaaaaagacaaaacaaaacaaaaacacaacaacacatatgctgaagcaaaactgggcaaaggcccttaatagacatttctgaaaagatgacatgaattgactaatgagtcaaaaagaagttgctcaactttatcatttctcccgcaaaggtaagtccaaaccacagattctctgggattctggagaatgtgaattctgactcagtaggtctggagtgagcctgagattctgcgtttctaaaaggttcatttccccacaaatccacattatgtgtattaatattaccaagtaaataagaaaggtcaaaaataaaatggcaagccattagtagataaccttagtcttcctcctcatcctcctcctccactgcatgggttaggatggtccccagcatcctgatcccccaggtcactgacatcagctcccaaactcatgccaggaatgtccttccctcttcttccttcaggccataatgggtatctatttttccagcatctttctcccaatctgtgctgatttagccaccctctgtatctgcctccctgggacaaagggtcaaactcaccagcactctgagcaagagctacagcagctgccacatagactatccccagcagagctcagtgatggacaccaggttcacaatgccagtgggcagtggtgctgtttactgcatccagtggggatggagtggttgtccaggcacagacagatggacaatcacacagcaggaacaaatgtacattctgaaatttaacaaagacagaataagggactcttggggaatagaggtctcaattgcagacatagtgagtgcctcaaaaattagagaactggggccatctctgtcatggcccggattcctctctccttcatcctcctcagtcatcaaagagattccattagggggcaatcaaaggatgctggggcctgctactagctcccaaaaaacaccacaagcatttcagcagggagaaaagaaaatgctcacaaggatggggttagatttagttataaaccagattgtgtggcaggagggaggacatatcccccatcctttggccactccaaaattgggagagctaatctggggaaaggcaccaacacctattcattagtgtctcggtcctgtgtgatcatgggtctgtgtgagttctcagcagctgcctctctcaaggtctccccacaggacagcagggtgaaacctggggcaggaagagaggggaagctgatttgcataaagaactttttttatcctattgggtctggggaggcatgaaaaggccctgaggaaaacaaaccccagctgggaagcctgagaacacttagccttcatgagtgtccccaccatggcctggatgatgcttctcctcggactccttgcttatggatcaggtcaggggaagggactctatccctgggggaccacagaaaacagggtccaggttactctcatcctcatgatcataactgtgtctctcctgttcgttttaggagtggattctcagactgtggtgacccaggagccatcgttctcagtgtcccctggagggacagtcacactcacttgtggcttgagctctggctcagtctctactagttactaccccagctggtaccagcagaccccaggccaggctccacgcacgctcatctacagcacaaacactcgctcttctggggtccctgatcgcttctctggctccatccttgggaacaaagctgccctcaccatcacgggggcccaggcagatgatgaatctgattattactgtgtgctgtatatgggtagtggcatttccacagtgatttaaacctatgaggaagtgcaactaaaacctctttatatactgagaacagttcagcccttacagacaggagggaaagtgagagggtggaaatggtcaacacggtgagtgaggagtctcctcgccccagtctctgacgcaggggttcactgccaggtgcctcacccagtctctccccgggtgtgtccaccttcccagtgtggcttttccatggctgtgcttcgtctccactgagaataatgtggagggagaattatctacaaaatatataagctcacagtgagtcacagacaccccagtgctccaggaagacgcttcttattcaaagagaattaacaggcatatgctcactcattaatttgaccatggaggctgactgaatattttatttatcactgaagtgggagcattttcaaggggcttgttaaaaatgtaattctctaacctaaacctactaagtcagaaacttgtgttggtgacagatagcctgtatttaacaagctgtacatgagatttttattagcgttaatgtttgggaagaacctacttttattatcataaaattattcataaggatctccatttataatgatgtcaggttaatattccataatcctactctcctaaattcccattcaaagcccccaaatactcagaaacagattttaaatctcaagccatagcaaaaattataacttgatttatgcagacagagtagggaggaatttctaaaaccgtaagttcctaggtgccaggtgtgctgactcatgcttataatcacaatactttgggaggttgagacaagaggactgcttcaagccaggagattgagaccagtgtcttccacatagcgagagtctatcaccacgaaagaaaaaaaaaagatataagtcccttcaggaatttccaaaaacttgtttccttagggtatatttagtggtccatatgaacatctgttactgaaaaccatcccgtagaggactggcttccagaatcccttctccctcccactgagctcacctacctgtggctctggctctcagggtctttataggacacagggctcagcctcttatcaccgattgttccacaggatcatggttccactgagatcctctcagcatagatacgtacctgtcctgaacagtgtcttttaacataatgttggcaagatgggaaggactaaggggtgacggagccttggagccaccagaagatggcagtaacctcactgctgagctttgctaggccagactcaggctcccaccctcctcccttcctctgactctttcttctggccacccggggtccaggagctttttccactcaatctgggctcaggggtcacctcagagaacctctcaagacaaaggaggtgcttcaggggatctaacacaagtgagggcagattttaagactgtccatgcacagaaaatcctgtgaaaagaaacaaaccagccctacttgtgtctgcgcacctgagtccttaggactgttttctcctgatctcctggctgagtaaagattgcaaatgtgcggttcattatccagatccagagaaatccatgagagtttatgaagacaaagacgacaactaccctatctacttgtcacacaatgaagacactggccttagatctgtcagtgccctggaacattctggaagaagagggtgaaggttacttggcatacgttgggactcaaacatgaggatctcatgatgacccagagggataaaggtgggatcagttgtgagggtggaaaatgtggatttcttaaggccattttgttaatccttttctcattgcaaaggatttaaactgaaatgaacacgatttttctaataaatgcttatgaggctttccattaaatttaatcatatttcctgcctttatgaaaataaatatagaaataaaatatacttccataatgcattactgattgtgtatctttaaactagagggaaccattacttctaaagaaaaattactaggattgtttgcattttaatctgggatcctacatgatggctacagatacagctgttgttcaaggttttagcctggaatctctgccaattcaataacggaggcaataaaaatagacactagtattataaagacagaattcatttattttgaaagttttgaaagctatgaatatctaccaagaataaaataaattgtactgaaaatatattagaatgaattaaaaaatgccaaattcacaactaataaaatttattataaagttaaaaattcttatatttttctgtctcagtataaaaaataaacatttaatgtatctattagaaaataattagcaattttgtaaatgatatcaaagaaaatttgaacaaatggtgaaatattttcttatctgcggacaccaaattaaaaaaattcaggccaggtgcagtggctcacacctgtaatcccaactactttgggaggccaaggcaggaggatctcttgatccaaggagtttaagaccagcctgggcagggacgggtgcagtggctcatgcctgtaatcccagcattttgggaggctgagacggcagatcatgaggtcaagagatcaagaccatcctggccaacatggtgaaaccctgtctctactaaaaatacaaaaattagctgtacatggtgacgcatgcactcctgtagtcccagctacttgggaggctgaggcaggagaatcacttgaaccggggaggcggaggttgcagtgagccagatcgcaccactgcactccagcctggtgacagagcgagaccccatctcaaaaaaaaattagccaggcatggcttcatgtgcctatagtcctagctactagggaggctgaggtcggaggattgcttgagcctgggaggtcgaggctgctgtgaaccgagattgtgctactggactccagcctgggtgacaaagtgagaccctgtctcaaacaaacaaacaaacaaaaaaccaaaaaaaccccaaaataaaacaaaaattcaacagcatgtagattagtaatgttagtgctttatttttaaaaattattgttaacttatatgggttttcctctgagaaggtgcactggaaggtgtcagcagagcagatagcacaaactcctcagatttcagaagcaggggtttatggtaaatgaaaaatgccagtcacttgtcagcatgcacaggtggctatgcccgccctgtgtcaggctctgtgtcagtagtagggtgctccatgcgtccttttcagagtcctacatgccatctatgctcactcagccaggcctgtcacctggaagtaacaggcaactcctcctgcactggaattagcagcagagtcaggtgaataatgtggcctggccacaccacctctcagcaaatgtccccagtggtgatgcccgatagttcccaatcctccttaagtaattaattcacttcaattgaattaaaaaaatcaatcacttccctatgacacacaaggacattcactctctggctttaactatccttgcctgccttgttattatcattccatgtgcccaatactgtcaaaagatgtatttttgccataccctccacatgcatttcatatgtgtgatttttattttcaaattctatatctcttctaggaatatggtgtgttttatttgtcctgctgcaggactcccctctccactcagattaaattattaaattccagataaaaaattaacttggaatactgttgaatcaatagtagaagtaaccaaaataataaagatatttcaaaatgaagattgatttttaaaagtaaaaatgtcacatactccacctagaagataagagactgtactacaaattcattagaacatccccttcatgtcatgggccagtcatgtccctgaacttaacctctgtcttctcgggtgatgttacaggccaatgcagcatcagctgcccacactcctagtggtggaatctgggagcacaggcaggagtctgcgcctgtggccttggctgggtgaaagatgacatttccaagacttcttgcttggcagccatcctcacgtgcaggtggtctggcagcagcactgcaaaacccaggcaagggatgccccactgcaaggcccagtggtaactgtggtggccattggcattgggggcagatgcagccatgtgagttggtgggctgtggcagccaccctaatgatggtttccacccctcccagctggtggtggctaaaaccacccggtaggagtttcaaaagcagtggcaccattaagcggagctcctggaggaggactggaagcaactgcttgcattgaaggaatgtagctatagtggaattattgaaccacatcatatttgcaaagatgcagaatgtattacagattacgagatatggaagttgaggttaatctggtagagagcagtgaatatgaggaggaagctctctattgggcgggtgctatcatagctgcagaaggtgatggtgcaatgcttctgccagtgagtaaagtcttgtacaaacttaaaccagttacggggtaaaatctgatccaggactacctgagggtcacttatgttggcctgttcaatacacacatttctttccaggagccttaccaaaggtctatagtagtgagttcagtatggaggcagtaatcagatcatatctggaaggaactggcataaactccaatcctgtgggacatcatggacagcaactaaattcgaatcaacagagtagagcccttgacattggacaagttcgtggtgaaagatctgaggctttaggactccgacatttgtgaatgacagcactaaatgaagtctttactggtgaacgtctatccagaataccttatgcttgggctgtggcagtggataatttaagtagacccactctatttatttatttattttgagacggagtcttgctctgttgcccaggctggagtgcagtggcgtgatctaggttcactgcaagctccgcctcccaggttcacgccattctcctgcctcagcctcccaagtaggtgggactataggcacccatcaccacacctggctaattttttgtatttttagtagagacagggtttcaccgtgttagccaggatggtctcgatctcctgacctggtgatccatccgccttggtctcccaaagtgctgggattacaggtgtgagcctctgcgcctggctaagtagacccactctaaaagactggtttcttactgtgagatttcagttggtaatggtccatgggaaaaatggaagacttcagggctcaatttgtgaactggagcaagatcaaaggcaacagggttgcaagtcaggctgtggagcatgattaaaatattgcaaatgacaaggacgttggagtcttgcattcaactgtaaaatgacagaataacaaataaatataatgaatcattgttctagagtccaaaaagggccaaaagtaattttcagtattcaagaactaaaaagcaagcagttttctcgagcacccatgagcattgtttctcctgagagatttgtcctcgttttcattgctggaacacctgcatggttgtagatggaggaatgtcttttgatgttcctatttttatatcagacaagctttaaagcaacaacagttataaaagacaaagaaggaaattttataatgataaaaggatcggtccaacagaacaatatcacaatcctaaatatatatgcacctaatactggagctcccaaatttataaaacaattattactagacctaagaaatgggatagatggcaccacaataatagtaggggacttcaatactccatggacagcactagacaggacatcaaggcagaaagtcaataaagaaaaaattgactttaattatatcctagaacaaatagatttagcagatatttacctaacattctacccaacaacttcagaatataccatattttaatcagcacatagaacgttctccaagataaatcataagataggccacaaaacaagtctcaacaaatttaagaaaattgaaattatgtcaagtaccttttcagaccacaatggaataaaactggaaattaactccaaaaagaacccttaaaactatacaaatacatgaaaattaaataatctgctcctgaatgacctttgggttaacaatgaaatcaagaaggaaatttaaaaattgcttgaactgaacaataatagtgacacaacctattaaaacctctgagatacagcaaaactaagaggacagttcatagcattaaatagtctgaaacagcatgaacagacaatctaaggtgacacctcaaggaactcaagaaacaagaaccaaccaaactcaaacccagaagaaaagaaataacaaagatcagagcagaactaaataaaattgaaacaaaaaatacaaaagataaatgaaacaaaaactggttatttgaagagataaacaaaattgacagaccgttagtgagattaaccaagaaaaaaagggagacgatccaaataagctcaattagaaatgaaatgggaaatattacaaccaataccacagaaatatgaaagatattcaaggctactatgaacacccttatgcacacagactagaaaatctagaagagatggataaattcctggaaaataagttattatttgaaaaagacacttgtatggccgggcacggtggctcatgcctgtaatcccagcactttgggaggataagcgggcggatcatctgaggttaggagttcaagaccagcctggccaacatgttgaaactccatctctactaaaaatacaaaattagctggacatggtggtgcatgcctgtaatccccgctactctggaggctgaggcaggagaatcgcttgaacccaggaggtggaggttgcagtgagccaagattgcaccattgcactccagcctgggcaacaagagcgaaattctgtctcaaaaaaaaaaaaaaaaaaaaaaagaagaaaagaaaaagacacttgcacacatgtttatagcagtacaatttgcaattgcaaaaatatgcaaacagtataaatatacatcaaccaatgagtgaataaagaaaacgttatttttttatttttagacggaatttcgcttttgttgcccaggctggagtgcaatggtatgatctaggtttaccgcaacctctgcctcctgggttcaagtgattctcttgcctcagcctcccgagtagctgggattacaggcatgtaccaccacgtccagctaattttgtatttttagtagagacagggtttctccatgttggtcaggctggtctcgaactcctgacctcagatgatctgcctaccttggcctcccaaagtgctgggattatgggcatcagccactgcacccagccaaaaatgtgattttatatatatatatataatatacaccatgaaatactactcagacctaaaaaggaataaaataatggaatttgcagcaacctggatggagttggcctcgtttactactctgggtttctgtctgaggatgagggtgatgattgctgatcaggatgcggaaggaacccagtgctaacccacagcatctgccccacagggaaataaggcacaagtctcttgtttgatcccacgctatgacctctagacctactcttccctcttgtcaccaaaaccacaatcaggaaaaatttctgcaggcatttcaccatcctggaacaaggatctgagactcttcactgaatttgtgaccttctatccagccaatatttatactgagctattaagattaacatcttagcctggtcattgccacacaggcaggcaaggcagctcaggtggaaaatacttttggtcatcccatgtgtctgggcatatggccttgatgtgagtttatgttcatgctcaggacaagttatgggtcaggggactagtcagcttatgggccaggaaaaggtgctaaggtttgtggagtcaaagagggaattcacacatattaatgctccttgtttccacctaaggcagtttgtgaagtctgtgggttctgtgactgtccacaaatggagcaggaacattccttagaacggatgattgggaccccacaaaggaaaagacaagaggaagcacaggctacacaatgaaaatacacttggtcatgccaaaggctaggtcatgccaaaggctaatgaaagagctttgagtataattcagtgcctttggggttgagtggaaaatacaaaaaccatctttgccctgctctcacaccacaacaatcaacacgtttccatgaccaaatgtgtaggatttctccccaccccctagaaagcaagccattggttttgcagcggacaccacacaggtgccctctcattgaatgcaattctgacactatccacatggagacagggtcagatcttacagtttgagggctacttccccaagactgtgccccactacttacgccaatcccaagcctcagattgctttacctgtgcttctgtccaaatagctgtaagttgaagatttcacaacatctccttggcttctattaatttgctagaatggctcacagagctcagtagacacttacaggtttattaaaaaggatacaaccaagcatatagatgaagacatgcatagcacaaggtatgggaagtggtgcaccaccgtccagtaatcttcatgtgttcagccttccagaagttctcccagcctagctccatttgggttattttatggacgcttcctcaccgaggctttatggagtaaaccactgcccattggtgaataatcggcagcccctctcccctccacagaggttgggagatgaggctgaaagtcccatccctctaacactgccttggtctttcttgtgacctgcccccatcctgaagttacctagggactgtcagccaacagtcatctcattagcatacaaaaagactctggtgattttaagtattttaggagttgtataacaagaaatggggtcaaagaccaaaaccataatttataataacacagggatgaaaaagaaagtagaggttgatgatttcaagcccacactagtcctcattatgacagatgtggatttccaacccataagaggcaggaggctgaagagctgagacgaaacctgtgaaaagcagggacaggggacatttctcaatttcttgttactgaagtgatagagctccaccaggcctcacttggattgacaaactaaattaaaagatacactctttaaataaaaagcacttctgagcatacatccaaaagaatgaaaatcaggatattgcagaaatatttgcacatttttattcatgcagcattaatcacaatttcaaagacatggagacagcataaggtccactaatcattgaatgtttacagaaaatgtggtgtatagctgcaatggatgctgttcaaattcaagaagaattaggccgggcacggtggctcccgcctgtaatcccggcactttgggaggccaaggcgggcggatcacaaggtcaggagttcaagaccagcctgaccaatatggtgaaaccccgcccctactaaaaataccaaaattaactgggtgtggtggcagaagcctgtaattctagatactcaggaggctgaggcaggagaatctcttgaatccgggaggcagaggttgcagtgagctgagattgcgccactgcactccagcctgggtgacagagtgagactctgtctctcaaaaaaaaaagaataattaaattttgccatatgcagcaacagggaaaaccctggaggatattacactgagtgaaataagccaatcttagaaggggaaatgctgcacggcctcatttatatgaggtatctaatttttttttttcgagacagagttttgctcttgtcacccaggttggagtgcaatggcgcgatctcagctcattgcaacctccgcctcccgggttcaagcgattctcctgcctcagcctcctgagtagctggtattacaagtgcctgccaccacacctggctaatttttgtatttttagtagagacacagtttcaccatgttggccaagctggtctcgaactcctgacctcaggtgatccgcctgcctcgacctcccaaagtgctgggattacaggcatgagccaccacgtccggcctataggaggtgtctaatatactcaaccgagcagaaatggagtagaatgctggttgccaggggtagggagagaaggaaatggggagtcactgctcaagggctatgaagctttaggtttgcaaaatgaacaagttctagagatgtgctgtacaacactgtgcttacagctgacaacactgtattatgtacttaaaattttattcagagggtatatcacacattaaacgttcttattaacatgaaaaagggatagaaaataccatgaaaccacttacagaaagcaagtatggcaatcctctgtcctttgtcttgggagaaagttttggccaagagacaatttaggcaaaaaagagaatttactgaagaaaaacagagagcaaatagtttatttagagagacagtgtactctggaagataaggcagagcgggctgctgatagagaatgagccagcggcccgagaaatgtgcactgagtttttatgatattgcactttttcttggagttcccacctctgttttaagtctccacctttttttctttctctagtttttctgcttcagccttaagtccctgccttttccccacatagtttccagcccaggctgtgggaccctcccttaacacacacatgggcccagtgtttgataggaattctacctaatggctgcattgctcattactgccaccccaggaaggttgtatggtggtcaaatctatacttactgtacctgcatctctcttagaaatttctcctttgctctcacccctattatcagcatgcagctagctacattctgacaggttaacttcagagtgagtgaatactgggtgtcttaaggggctttgttctggcataggtatttaccctaatctctgttcgtatctagcatgtgtgctttgggtggtctctggggtgtgagattttccagaactcccttttctcaggggctgcccctcctgcttctgtctagctatctgcctactctaaagttagtattagtatgaaagcttttatgaaaaacatttttttccaagaaaagggaggcattttatactggtgaaataaggtgttcaatgacaacacataacaactgtaaattgtatgcacctaataaaatagctttaaagtatttgaagcaaaactgtctcttttagcagaattaaaaagagaaataatcaatccataatcatatacacagatattaatacaactctcttattaactgagtgaatgacatggagaaaaaagagtatacatacaaatacgtgaaaaccatgattaacaaaatcaatccagtgacaccaggaacccaagcctgaagggtagttgcttgagtatgcattcatggatgaacgcatccaatgaatcatcacaggaacaaacaattgaggccttcgtttatgtatttctaactgatgttaagtttttccttcctattctgtgagtagaggtggatccctgtggaaggagctgcccgggtctttgctccagaagctgtctgcattctcccctcactgtagcctcgtcacattaggccattgttatatttcccatatgtccttcttctagtaatccaggagccctcaatgaaaaggctgtttattaataccagtagctcaggacagagcaggggcatggctcatggatggtttggaccaggcccttagatgactgcactcacatgattcccactgagactgcagtctggccagtgagcagcaggggcactgtgggtctgtctcacggtctgcacagtggctattcatagctgtgccaacccctaaattccccagggctgggcagtggagcctgcactcactgaagccgactcagctgctgcatcttctctgggtgtggttccagcacccacttcctcccaggtcctgccagactctctcatccaccagtccccaggtcttgaataaatgcatagagtggggtgggggcaggcagtgggtgggacacatttgcatccataacccttcctctgtgaggccagtggaggggataagagaggcctagggcagccactccagctctggacctcgggagggctgtgtccaccatggccggggcccctgctcctccctgctgctcccctctcacttatcaggtagggacaggcctcagattcctgggaaagcctcccagtctgagttcttgccccgtgttccactctcacatttcatccctgcttactcacccatgagcatttgtgtttgcaggttccccccacctcggcctgttctgactcagccaccctccctctctgcatctctgggaaattctgaggctcacatttaccctgagctgtggcttcactgctggtggctagcacatatcctgctaccagtagcatctagggagtgctctctagtatctcctgagagatgatatatctccagtgggatagatatctcaagagtgggctcctgataaaaggataaagttcaaccctatttactcattttcacactcttctttgccctttttctctgagataatgcagcagaaagacccttgccagatttcagcatctgcttgtggacttctaaggtcacagaaatctcaaccaaataaacttttagtctcagtaagttacccaatatatggtattctattgtatcagaagaaaatggagaaaatggactaggacagcacgtgtagaacagtctgctaatctgactcaagtaagcaccatggctccagggtccccggtcacttttctaaatctaaagatgcctcagccaatgcagtaattctgcacatctctgggctgcagccagaggatgaggctactacatatctcagcagccatggcacttccacagtgctccagacccccagggaagtgagactaggacctcccctgtgttctctctgcctggtgcaatcaccactgtcctgcctgggaccaactctggctcagggattgattcctgttgttactttttcagccagtgtctaattttcctaggatatatagatgtaaaatgtgtttttttcttaaaatgttaatttgatatatttttcatatcttttccccttatgatgcctacagtggagtaggtcagttcttagagctaagtttccctccaggaagattacagaagaggaaggagatgaataacctacacgtgctgtcctagtccatttcccccattttcttctgatataatagaatatcatatgttgggtaacttactgagactaaaagtttatttggttgagatttccgtggccttagaagtccacaagcagatgctgaaatttggcaagggtctttctgctgcattatctcagggaaaaagggcaaagaagagtgtgaaaatgagtaaatagggttgaactttatccttttatcaggagcccactcttgagatatctatcccattgccaggataagggcactaatccattcatgatggtggaaccctcatgacctaatcacctcttaaaggtcctgcctccaattacttttaccatgataattaaattctaccatgagttttggaggggatattcaaaccatacacatgtcccaaactagggcctagacctgacttagagatgtgtgtggtctgagaacttctgatcagctggttggtccagcatgccccaaccccagctccactgaccagctccaggagtgagtgaggtcaccttcctcacaactgctcattccagcctgtctctgaactgttcactcctcttgaggttcagaggatgcaggtctttgtggttccagggatgttgggcaaacagtcttttccacagtggaatatgactgtgcttgtgacttcgcagtgtgcagaggacactcagcacctgcctctcccccccgactttgtcaggcccatgattatcaccctctccttcatcccaagttcatctgatacgcatgccaagatttcagtgaggctggggacacataaggatgatgatactaaaatgaacaagttccatttcataatagtggcagaagatcagagatctgtaggggagttgtgcccccactctgagtatttaggaagcaactctagggacatcttgctctgcttctcccttctctgcacaggtgaaagaaggagcctgtgcagacaatcgttcattagaagctcctgccttcttcctcttttccaccccctaggactggatggggcctttgtaatggcttcaaattatagtgagagtcaaacaagacaattggtcaatgactccaacatccctctcagggctgcctgacatgagacaggatggattgcatctgatacacccccacccttctttcttatcggtatattaggtttttcttattgatgtgaacacactctatattacacaaaataagttatatttatatttcaaacctgtgatggtgatttttaaattatagtaaaaatatacatataaaatttaccatcttaatcattttaggtgtacagatcataagtattaactatattcacattgctgtgcaacagatctgcagaaattatccatcttgcaaaactgtagctattgaataacagctccccattttcctgcctcttgtggtggttttaaatacaatgcaatacatactagctgaaaatggaaaaaagaagtatatgaaaatgttaaatgcatagcacaaaaaatgaataatagggtcactttggttataactttaaatgagaaaactcaaagtaaaacaacaatctatgatatatcatataaaatgcacaatttaaaatttttaaaatttaatattaacaaaaatatatgtaatacaccacataagtattcaataaaactgaatacaattatgtttaatttttttaaactgtgaaaaagatcctattaacttttgaatatttacgcaaggaaaccaagtacatctcttcttgaaaaagtttgattccaattttttttttctttttttttttttgagacagagtcttgctctatcacccaggctggagtacagtggcgtgatatcagctcactgcaagctccgcctcccgggttcacgccattctcctgcctcagcctcccgagtagctgggactataggcgcccgccactgtgcccagctaattttcttttgtatttttagtagagacggggtttcaccgtggtcttgatctcttgacctcgtgatctgcccgcctcggcctcccaaagtgccaggattacaggcgtgagccaccacgcccagccagtttgattccaattttaacagacaggtgtttttgacaaccagtttattttcttactgaaattttctttttctttttttaaaaaattttaaatctttaatttccgttttcacttattttcttcttgcttccaaaaggaaaggagtgcgtagctctgttgcctgtacatcgtccacagcccctggctcggggcagggtcccctaggccgcccgggggtccacatgcagcccctggggggccggcgcggggtgaggtccggccggttggggccgccgctaggcgcgctggctgggcagctcctgggagatgaagcgacgcaggcgctccaggtactggctgtagagctcgatgtcgttgtgtccggcgccctccacccacagcggctccaccgccttggggcagcgctcgtagagcgccagcccgtgtgagaagtcgatcacctcgtcctctatgccgtggatgatgagcacgggcgacgtgatcttggacaccttctcgatgttagggaaggcgtcgaagcagtaggtcttggtgtcggggaaggcgacgcgcatgcccgaggtgagcggcgagtgcagcaccaccgcggcacactcgtagcgcgaggccaggtccacggtgggcaccgtgccgatgctctgcccgtacaggatgatgctgtccgggctgatgccgtacctggcggcgccggagcagggtcagccgcggcctccgaggcgcgcgcacccttcccaccagcgggcgtccccgggcccagctccggatgcgaccctctagtctccccactcagccaagtcagtgggtcaggcccaggctccacaccagtcccgagggccacccccagcccccaacaccgcggcggtgggcgaggccagcggccccgccccgttccctggcgctgccgttcactggcgtttcctagcaaggatctgcagggatcccgcctacggagtgcccctggggcaggggtaggggaggccctggcgcctgttctcctcctggtcacccctaggtgcacactgggaactgtgtgccccccacatcctgaatgcttcaggcctccctgcccgggttagaaagccgttcctggtgcactggccaggacagcggacactcttccttcctgcagcccttgcccacccccttggccatgaggaattcaggcagctgtgtccccagatgtctccacccaattttggactctcggagtccccacgcccaatgagatgccagtgcaacccaggtcagcatcgaaggtggtggctgcggaggtggcaccccctcccaccagcaccttcccttgggagtggacaagtcctcggccacctcagcaccaccagctcccacccagggccacccccacccccaggtcattggtgtgcggcccttgacccagctgatccagcaccagttacaaggcctcctcgtacccagtcccaaccacgcgggacccacctgccaccctgcccatgccaggaccccacaactctcctcccacacgctccaggctctgatcccaggcagacaccctcttgcaaggcaggagcatgggcaggtgtgcgtcccctctgcctggcattcggactccaccagcagggctgtccccgtccctggcctggaatcccagcctcctggcagcactccacagctcgccactcacccatgccccaaaggatgctgcctggctggtacctgtggccccagctctgcctcggcctccctggcctgctccctggcagccatggtcagtagtgtgctgagccagcccagccctgtcacctgctacaggcaggagcccccagctgccacctggatgtccccactcaaatgaacgggacacatccccagtggaggccctgggcacgctctggcctccccctcacagctctgggcctaggttcctgcaggacaaagtggcagcaggacagatggccgagcagacgagctcagagctggccatggcgggtgtgactctgccagtggcccaggcagtagagacaggaggggccgaggaagtcgcatgaagtggtacttggtgtcagcgccccacactgctgggaggcccccagagccagggtggtgccaggggaccagctcccaggcccacagcagggaccgcctgcaatatcaccaaggcaacgaggaccccacctccccagggcctctgacttctcagagttgtgcctggtcccctgtgggagcaggtcagaccagtgggctgggcagggccaggatgagacagccccagtggatggcgagcaggaaaggccgccagaggcccacccgggtctcctcgtccaaagcagcactggcccgggcggtgctcaaacaccggtgaagggcccaggcaagcgcagggctggggacctggatgactaggagggctggatctggaatcgaggctggcccagacctcgggtgtgtgctgggggtctgcaccttaccctgcaggccctgccccaggatggccaagctccgcagccacagggcctcatgggccaggcctcgggacctggatgcagcagcctcgcctcacttggccccaagtgctgccttggcagatgggctcccagccacacgtgcacagacccccagaccaccacccactccctcccaccgggtggcatccacgcccctgtgacaagctcagccccttcccgtcctcaggccaggggttccagggagcctggctccacaggccagggtgtgggaggaccgcctggccacacctcagccatgtggaggtggcacctgcacacccaagctcgcctgtccggctctctggccctgtgcatccactgtggctcccctcctgcagggccgcccaacttcctcccagggaagcccgccccccggcccccggcttggtcccctcttgggtgtgcccaggctgagctgcccccagggtcgccctcacctggtgtgcagggcctgccaggcggcgtcgatgtcggcatagaggttcctctcggaaggcctgcccgcgctggcaccgtagccggagtagtcgtagaagatgttgcaatggaggcgggagcccaggccaatgtagaagctgctcatctggctcaggtccacggcgttgccgtgcgagaagaagaccgtgtacctggcaccaggcacgcagcgaacatacatgcaggagacgcggttgccgcgggcgctcttggtggggaagacctcgatggtgtccagctcgcgctggctgtactggaagtcggcgcgctccgtcaggtgcagcttccagcgcccaggtgcgcccgaggaggcccgcagggtccccgagggggcggccccggccccaccaggccccggctcaggctcaggcaccaggaaggcgagcttggcagcgatgcggccggggcagggcgggcagcaaaggcagcagagctcactcagcgacagcccattcatggcgggcgccgcccgggccgggcctccaccggggcccccgccaacaacgccgcctggcctggcccggcaggggaagcgtgggggtgctccgagtcgcgggcaggggggagagcgcccccccagctaccgccccagacggcagccccgttaggaggccagggcccagccccatcgcggtccaagccgagccccagggagcctcgcaaccacaggtctccatgtcgtgccctgggaagcccatcccggcccgcgcccccgggccccagggccgcgctccatggctcccggccgcccgcccgtgcatccgtcggtccctctgcgccccggcccggcctcctgcaccgccaccgccgcagctcccccacggacggaagtgagtttactgaaattttcaagccacagaaagaacaaaagaagtaatatccattatattgtccaaaacaatagtacctggaagatctggaggcaaaaatgaagcctgagaatagcaggacatagacatatttcataacatagactcacagcagaataatggttatgttggttcattagggaagaaaacactaaacagctcttgcagatacactcaatatacagtaagatagcttgtgattttaacgagttagcaaagcagaacaatgaggcaaaagcaaacagaaacactaaaagaaatccattccctagaatcatttttaaagactttgctagatttaccaaagaattcagtattgacttattctgtctccattttatttcataatggaacccgtctaattttatgctaaatgtatgctgtaaggacaccttgctactctgaaaaaataagggatcagtggataaaagaccatattttattaaaaaaagagtgtgttttgatgcatgattttgtgactctacatttttaagtaaggatgaagaacttggtgattaattaaatgattcctcagttgctcatcaatgccatcagatgccttgaatatactgtgaggacagcatctggaagaaatggaggagatctgagtaataattcagatggagccaatttccacaatcttattttcccattacctgcagctctgaatttaactaagtctctgtgttaacaacttgtattgtttatctgggtgaatgacctcagaagacaccaggcagctggatgcctgcacttctttcgtgctaatggttcatatagtctcctcacccccaacactttgatacttccttgaaactggattacatatgagatagaaacaaagaatgcaggtggcataatgactctcaggagtcactgaatctgtgttcatgatgcattactgtgccagctgcctccctcttcttgtgaaggcccttctttattccttgagatgtgctcatcatgaaatagctacaagcatatcatctgcttgccttgcccgttatagcaaccatgaaaataaatttgcagcatcatatatagcccaaatattctcgaaagatgatcctaatagctctaataacaaaataagttttctacagagtagctatatgtacatgctctcagcttatgtaaacttgtgtttttattgctcttaaagcaaaatttttcctaaaattgagaaaagaactaaagttctttgtcattatatgaagaaagatacagcatctaatattgtgaacttctctattttgagatgttttcagacatcaagactggataataggctgggcacggtggctcacgcctgtaatcccagcactttgggaggccgaggcaggcggatcacgacgtcaggagattgagaccatcctggttaacatggtgaaaccccgtctctactaaaaatacaaaaaaattagccgggtgtagtggtgggtgcctgtagtcccagctacttgggaggctgaggcaggagaatggcgtcaactcgggaggtggaggttgcagtgagccgagatcacgccactgctctccagcctgggcgacagagcaagactccgtctcaaaaaaaaaaaaaaagactggataataaaattatttaacaattcggaacataaatttagaattgaaaaaagctttatactatactatactatactatactatactatactatactatactactaacacattttgtttgagcatggttgccttataagtttttggtagttcaatgaaaataatggctacttgtgagaaaactgaaatagactaggacatagtagatagagatagaaagaacaggtaaattaactgtctatgccacatggcaaagaaagtttacagtacgtagtcattaaacgtacatgcttataaatatataaccaatgatgaataattttaaatgcaatttagcagaattcagaccgttttatattaaacatatatttctgaatgaaatataaaatctattgaatgagggagacactttatatgtgtaattaatctcataaatagagaagacttttacaatagtttgtacactttagctataaactgtaattcaagagattcagtaagagtagctttttgtaacttaaatattctatattttccctgcatacatttttgcctttgatcatgtattttatttagcctgctaagatggtagagaaggtacagacagtaagcttttcaacctgacacataaattcaggttatttgaaaatggaatggtaaagtgttactgaagaacttttactatggttcgcatttggtaatatttcctaattattctataaacaaaatccaaaaaaaccttgatttcataacataaacttctgaggtctaaattaatcaataaaataaatttgttttaattaattattagattaaattatttatttaaataattatttaaataattatttaaataattaaattaattattagattaaatactagctgaggctcattagaggtaaactagagaattatcatcccattaagataaattttgattcagggaagtaacatcttggaagtttactaaatttaaatttaggaggaatttactaaatcaagtaccaagattttatttctgcaccaaatggaagacatatgtaaaatttaaatacattccattacttaatttactctttactatcatgagaattagtatagacagcatattttacacagagcatacaaagccttatcttcattgaattacaagtaaaatatatgtatgtacatataattatatatgtaatttagatattaaatgacagaatttacttatttacctgtgtgtgatggaatttgattctagtaattattccaggtacagtaactggttgaaaatgggacatgaagtaaactgatatgcttacaagtaattacagcaagcgaattcattgtaatgtctccaagcaaagcaagactacccacatgagataagaaatgagaggctacttattttgaccaagttagctcggtgacttggggaccaaggactacatgcacatggatgcttcttttgtacccctacccctgccaaaaaatatgtttccatggcaatatttgggaacccattatttcccaattgatgcttttactttcatataagacaacagttgatactccaaaatcaacttacattttaattaaccaaatacaatgttcctaaagacaaagagaaacatttcataacaataagagttaagccaacagaaagatagggagtatgaaaaaacagagaaaatcaataaaccaaaattaaatgcttgaaaagacaacacaattggcaaatgtttatttaggctaagcaagaaaaaagcagaagagactcaagtttctaaaatcagcaataaaagagaatccatcactgctagtaatacaaaataaaaataaaagacaatgcaatgaaaatcttatgctaaaaaaattagatagcctagatagaatgaagtcctagaaagacacaaactaaaacagactaaaggactaaggagcaatagaaaatctaaatagacctacaaaaggtaaaaagattggattgtaattttaagaacttataataaaattcccatctcaggtagctatcactctgagaaattaatatcaattgttcaccaactcttgcagaaaataaaaggggagagaacacttcccaattcatcttataaagccaggattactctgacaccaaagctatatcacaaaacaatatataacagtatctttcttttttttttttttcagatggagtctcactctgtcgccaaagctggaatgcagtggcccaatctcggctcactgcaacctgtttcctgggttcaagtgattctcctgcctcagcctcccaagtagctgggattacaggtgtctgccaccacgtccggctaatttttgtatttttagtagagatggggtttcatgttggccagactggtcttgaactcctgacctcaggtgatctgccaatctctgccttccaaagtgcgatataagtgtcagccttatatcacggtgagccactgtgcctggcccattgtttaaataaaattaaaaatcttcaacaaaatactggacaaactgaatccagcaacatataaaatagattatacactatatgcagatgtgatttaccccagcaatgcaacattgatttaatatttgaaaatcaatgcatacaaaaatcgcattaatagaataaaacacaaaaatacatgagcatctcaacagaaagtatttgagaaaatattacacattttcatcataaaacactccagagttatggacaagaagataacttcctgaaactagtggtagttatctatgaaacccacagctatcattatacttaccaaggagagagtgaatgactaatcagaatgaccactcttgcaaattctccctttttcaccttcctgctctcatcaccctcttttgctcctccatcttcccaaaaacattttcccccatcttttcccaaagccttctcccctctcctgctgctcaccaccattttatccccctccacctaccccaaaacttttttctcacacccccaccatcttttcacaatgccttctctccactcctgcttaccaacctcttttccccactcctgcccctctcccatatgccactcttttttcaccctccatctaccccaaaactatttgtcttcccaaccctcctccccctcatgctcgccaccatcttttcctcctccatctacccaaaaacttttctccccactgtctttttgcaaatccttccctccctcccgcttgcccattttccccacctttaccaacctctctttactcctcccacttgccaccctcttttccccctccatctgcccaaaaactttttacccaccatcttttccccaccctgttttcacaaaaccttttctccctcctgctcagccccccgtttttccctctcctatttgccaacctcatttccccctccatctacccaaaaacgtttttttttcccaccgtctttttcctattgcctttttgcaatgccttctcctgcttgccatcctcttttcccgttggtactcaccaccctgttttcctcctccatcgaccccaaaactattttccccctcttaccactccggtcgcactgcagtcgccatctcggccaccacccacagtgaggcgagccgcggtgccgcaggctgcagcctccagcatttggcaggtgtcttccttccccttctcctctgcctttaagttgggcacagaagagctgtgtaggcaaacaggaaagaacccgggatggtctgactcccccacctcagcatactttatatgcggagttatgcaaatgagttctgggactacatgttctgattggatgagagaaaaacctctaggcatacttagattggactttgttatcatgttctgactggatgagagcaagtcttaaaacgaccaatcagaacatgataataaagtccaatcagagtaggcctagaggtttttctctcatccaatcagaacatgcagttcaggaattcatttgcataccctccctgtataaagcatgttgagtgggcagagtcagggtcttccgtatattctccccgcaccatccgtgctcggcttagtgcaggaagaggagaagaacgggaagacaaccgcggcacagcagcttacgtgctgatgttggctgtggtgatggagcctgctaccggagccacagtggcccacagcgggagcatggccagagtggtggaaagacagtggggcaggtatgctatcagagctgcgctgcccgcggtgagggcagattgggggcgctatctggggttgcattgcctaggtgggttctgtgcagtatcggggactacgttacttgcggaggtggaacaggggaagggggtggggtgggggggacactattgaggatgggattaggtgtgctatcgggggccgtgctgatcatcaaggcagcttaggtgtgctatcggggcaggggacacgctgctccgagttgggggatgttacaggggctacactgcctgtggctggcaggggttaggggcactatctggggctgcacagccggtagtgggtggcgtgttagggacgctataagctactgtgttgtctgtgccccagggagggttaggtgtggggttgggtgtgctatcggaggctacagtgctagcagacaggttaggggcactgttgggtgttgcaccgcttgtgccaaggggtatgtttggtgtgctatttggggctacaaggggcaggttgggagcactgtcgggtgctgcactgcccatggcaaggggtgggttgggtgcactatcaggggctacactgcccagggcggggcgggcggggggggcgtgctatcctgggcttcactgcccatggcggggggctggttggggacgctgtcataggttgcattggggtggtagggggcgggttcggtgtggtattgggggctgcattgccagcagtgtgggggggggggtggttgggggcactgtcaggagcttgcgctgtcaagctagtagcaggttaggtgtgctattgggggctgcactgcccgaggtaggggggcggattaggtgcgctattgggggctaaactgcccacagctggcggggtttgggggctctgttggggggttgcagtgtcagaggcgggttaggggcattatcagctgctgcactacccgtggcaggaatcaggttgggggcactatcgggtgctgcaatgcctgtggtggggacgggttgtgggcattatcgggtgctacactgctggcggtggagtggttgggggtgctatcggggtcacactgtcagcggcgggggacaggttaggggtgctatcggatgctacactgtggtggagggcagggggtggggtgttgagagcgctatttgaggactacattgctggcagcggggggcggattaggggcactctcagggctgcactgccggcagcaggcagcagaggtggcagtgacagcagtggtctccacggaaaggacagtccttccctccctggactccaggctttacaaagcgattttctcctgcttaagtacagaggacatacagtgtttccgcaggaatactgagcacggcagggccccccacatctgctgtggtttcctgggttacaccctctcgctctgtgttgtggatactgcctgggacccccaggcaccgagtaacgtgcaccacgtgggggacggtgctctctgggtggaggctcaggaatgagagcccgcacttgggtggggagagctggctgggtctgactttttgctgcttccgttcccctaggaccgcagctctggtgggcccagtggttcctgcggagtggggagccgggcactgtggtgtctccagtccccaccacaggctccgattcatggccagcttgggccgaaaggggagggtgggtgtcagtgccttcgctgaaactggcacctgccacccagtggccagcatgaccaaggtgaggctttaatgctaccactccctgcatctgttctaggtttttctggctttgcctgcccagcagtctgtgcccacctagaggagtaggaggggccaccatgccgcatgctggaggctggagcccgcagcctgcagatggcacagtactacagctcgccttgctgcggttggtggcagtgatggagactgcagctcgaccccagcgatggaggctggaggtaggagggtacctggtggtggccacgtggtaggagccttgtagggtggggctggtgcattgagagcaacagcagcagtggttgtattggcatgggcattagtggtggcagcagcagcaagtctgtgagccgggaagggggtagtaggagccctgcaaggcccagctggcctggggtgggtaagaagcagtgggtgctgcagcatgggcctcggtggcagcagtggaagtgcagccagggcaaggagtcctcccccacctttctgcagtctctggagggcgcccacctcctgctggctcctgagccaggcatgagtggcagcattgtctcattcttaacaaaatttagggaatgactatttgtgtatctttttgcttgttttttgttgtgttaatcttggacttttcgaatttcatgaatcagggagtggataaaaggtatcataataggccttctaactctatcacctgatttttttcctttcttccagtctgttttttcttatcaccatcatcttgttctttattttcttatgctgctgcctatatttctggtttctattcttgtttctctttctggtcctcctgctttttgttttctttatcccaagcaatggccttaacaaactgaaactgagttaaaagtaaactacttgctagtgtgttgtatttttaaaataattggtccattactgtgttttagagatgagaaagtagttgcataatgatttagttacttgaatagctttgctttcgtgatcctgttaatgcgttgtaagtagttatgcaaggaatgaaaaaatgaagcatcaaataaaatactgatagcaaacagtcatttcatctctctcccatatagtctggagataaatgcaagtcagggggttaataagttccaaaaatttatgagatcattaagtgaaccacattcccttcattttatttttctgccacagttttcaagagcgttgtcatttgcatgagcaaaccttgttcaccacatctttgcaacagggaagggaaggggaggatcatatgtacaatgttttaaggcaaaaaaactcacaaccaaaagcaaggctttattaactttcaccttcgagaagctgcagtgttgagccctgttttattcctagtattactgcctttgatacgaactcttaagtgatcactttagaagttaatgcattttattgactgctttcaagaaacagtctatattgtatcatgcatgtttttcaagcccgcagaattgtataaggcctatatatacatagggcctataattttgacactttttaatgatttataaggttacgatcatgtaaaatcctgttgacacgtgagaatatgcctaagtaccgctagatagcttattttgaagagatagttattttgaagagatagaaattggttgcagtttgttaggtgtatttgtcaatgcattgcctcaatgctttaaagcatatagaagtttgaatatgctttaatctcatgtagtcctttgtttatagggtgtttaatatttttaaagactaaagatgtcacagccccctttaaggttcagtaatattaagattggagatttatagggttagaatccaacaaattcagaggaaaattgttaaattatatagctgtagagcaggaaatgaaacccaggttctaagctctaaggggaccatgagctgccataccaagtgcatcagtgactgggcatagagttggcagaattacaggatggttaagagagtgagctgtagagcctcactctatgtgaacatgaattttatataagtatgtatgtatttatttattttgagatggagtctcactctgtcgcccaggctggagtgcagtggtgtgatcttggctcactgcaacctctgtctcccagattcaagcaattctcctacctcagcgtccccagtagctgggaatacaggtgcacaccaccatgtctggctaatttttgtgtttttagtagagttggggtttcaccatgttggccaggctgttctcgaattcctgacctcgtgatccacccacttcagcctcccaaagtgctgggattacaggcagccactatgcccggctgtgaacatgaatttttaaactgcatggtgctttgggtcccagcttctccatctgtacaatggggacagtactaaggttttctttttcttctcagttgactgaattatttccatagtctgtctgtcttgccactcttgttacccacacgaaaggacctaaggtaatttctgacagcctgggactccttgtgcaaaacagaaggtgccacagacctcattttaggagaaacctttgttttcctcttggaaccccaagaactgtaagcagacaggtccatctcaaaatccaaggctctgctctgttttgctttgctttacctgactttttttttgatttgggtgggcatcaaaaattagtaggggagagctaaagaaagttgtggatatgaacatgtatttatggtaaggtaagttatgaaggagagaaatcttaggatcttgtatggcaaattcttgcactaaagtagataatgactaattaggaaagcaggaaatataggacaagtcagaaagtcataagatgggagagaaaagcttacgcctggtagatcctctcctgtctagaagtgtcgtatgtgtgatgtttatatgaaggagctctaattaattggattaaaagataatgaaagctctaaaattgtcagaaaaatagaagctctaatgccttttatttcacgtgacttcagcaatctttgggaaatgagagttttaaaattattggtggtaaaaagtcttcaaaaagtagacatttggtctaaattaagtcagaggttaaattggctaagtgctttaatgtcataaactgcttctttgactttggaaaattgttcagtttacctaatttggaactgttagatttctaggtaaggcctggggagaggtggagttagccatgtctcctagctatgctggaagagttagactttatctgcagttctgtcatgtatcctggactctgcacctggtatgtaattgaaactgcttacattgaaaagaaaaattatgtgtttttggttttaaaaggggtgggaatatggttttttccaaaaagtgagttttggcaaatttagaaagtttaagaattatttttagttgtaggaaaataaagtttaagcaagttatagaaggtttatgaaaattaactttgtaaagaattgtgtgtgtgagcaagttgactaaagggacagtaatgttagatgtaataaatgcaggtacccttccactttatcttctgtttcttaggttataaatattcactacctacgtttctaaaaactctttcactataatattaacacataactccattctccttgtattgcctgctttttcatagtatcctgaaattgcattagtagatttagattcagaagatggtggggaagcatcttatgagtgttttaagtaaatttaaggcaaagggttttctgtacatgggtggttatcacagcatcacttgttgcagcaaaacactgggtaacaacaatgtttatcaatgagaaattgttcggataaatgatgatttgtgccttgcgaggctcaactattcaaaagcaccctcttttcctcacttgctttacctttggttctgggcctggagcctttcagaggttactcaggaaatggactcctgtttcctgtgactaatctggacagcggcttcctatttcattcttcagcatcttccaaaaatttctgaagataatttcttcctttgtgaccacccatactcttggtttactttgcagttaacaatttcatgccttcactagattatctgtgtgaaggtgtggggtgtatgtgttcatactctggagggagcagaggaaaatagccacagccaaaggagtaatcttgcactaaatactcattataagaatgttgatacgttcatagatggtaaatctgtcagtaatttttacttgtatgattcttggttaagactgcactcactggtgataagcgtgctgaagggatcataggtgctatacttatgtgtgggaattgcattcaaaccaccaatgcctgtctactcaagttttgttgccttttgattaaaaactcttgggaatgtttccctggcatgcaaatatgggaactgcagtttgattctaggtagaaactctttggtagttgaaatgccataataagagacacagctgtcaatgggcaacaattcactgttggtaaggaatttacagtgctacttgccatattcttctttatccagactttgtgccaagaaaatgaaattctttttaaaaatttttttctagagtaatcctacaatattgctgttatcaagcctgatgctgtaattagtagaaaatgtctagaaattaaaagaaaagtagtattttccaactatggttaaattaattgcaaaataacttcctcttaattgtcagattggagacaagcttattaagagtgaaataaaacataatgtgttgctggtgctaggtacctctaaagcctttgagcactttcttctttataaaggctcaatctactcatgtgtcctgtaaataatcctgctctaccagcatcctatgtaaattttaaaaattatagttcatatattagattgtaacaaatgttgttcttctttaattatatgcaatgcaatcttgttatagactcacattagcttgccttattccctgtatgtttgctgtaaaatgtatagtccttttcaatatatgatagcttaaagatggacttaatattttgttttagaaccaaaatcttttatcttatatacaggaaaattacattggaattcagagatcagcaaacatttcctgtaaaggatgaaatagtaactattttcaggtttgctcagcatgtggtctctgacaactaaactctgaagtcataccaaggcagcatcagtaatgtttaaatgagtgaatggcgctgtgttccaataaactttatttacagaaacaagtggtgggccacattttgactgcagggtatagtttgtggacccctgaacaatggctttttctgaaacaacacaattgaattgagatttgaaagaatgttgaggcagcattgtttgtctggggtaatacctgaggtttgtcatctcacaccagggaaatcagggatgtggacacacaagaagtgagttcaagagtggatgattaataggtgaaagaaagagaaaagagaacagctctctctcctgcagaaagagagaggggcacctgagtgggtcttccggttttgtggtgaaaagcacaaggttttataaaggagcttgaggaggtggtgtcttgatttacacagggctctagagactggttggaccaggtgtgaacgtttgcatagcacagggagaagctggccattgcaccctaatcttttattatgcagatgggttctttaccttaccaggaccatattgtctgttccttactgtacctgtggttgacagagaaaagggaagatggagccaccatgttgaacatgcctggcccacaggtagccttttcctattggcacagctgctggcattcctatgagagcttatcaatgtctgcagcccaattttacaagatgctctttgttagaaaataaatgatatgggttttttttttcattagtaggaaaactttacactaggacttccttactttcagtatctgcctaaataatttctttttaattcctacatcaatgttgcatgtgcaatagagaaggtgacatgtagggagctgtgtcagcaggggttgcatatttcttgatgagcatcccatgatgcattcttcttcacttgtggcaacattagcattaactaatctacagtaaagtagatgggtccacaggtcatgggacatacactagctctgccaattacatgttgatttaaataatatcattctctaaggacagctttttttcccccagatcctggtatgtatgtggagttggggagagacaccaaactgtaccccatttcctcatacattgcttatacttttagaagtgtttgaaagataatatcacatactagtagtttactgtttcttattcaagttagttttaatagtcgctagggtgaatgttttcaaaattgtatagatattcgggttgaggcaatactataaattatgagttcatctcagtttttttgtgctagcgtaatgacatttcggagacataatgcatatgtgcaaaatacttcacctctctggaaaacagtaaagggctacataataggacagacaaaaataaaggcttggcgtaatggctcacacctatgatcccagcactttgggaggacaaggcgggtggattgcttgagctcaacagttcaagaccagcatgggcaacatggcgaaacccatgtttacaaaaacgataaaaataagccgggcgtggtggcatgtgtttgcagtctgagatacttgggggactgaggcaggagaatcgcttgagcctgggaggtcaagggtatagtgagccgagatcgtgccactgcactccatccagcctggataacagagtgagaccctgtctcaaaataagtaaaaatttataaaacaaagaatgtttctaactgtaataaaggagaagtgatcaagcttaagtgtagcttagatttaatctttgatttccgggtactatattacttaaaaatatgatttggatatttagaagttgttcaaattagaaactcaggagtggggtcactggtcactaaggtgctgaatatttttaataccttagtggatatgtaatcaacaaagccaacggaaccaatagagcatttgctttcataagaatttaagtgttgctgggtactcttaaatcgagctcacattattggtgtcatttaatataattactgaatttctttgaacccagtttccactttttaaaaattatttagctcattaggctgaaaacttctctttgttacattttattacacttcagtgtaatatgtgtaagatgtacattgcttctctctagaaaggtgagacaagttgaagcagggttgggggtgggtgcttccagttcataggtaaataggagacaaacggttgcattcttttgagtttctgattatcctttcactgaatacacaatttacatgcaagatgccatagaggaatagtcacttatgcctgagtctggcttagtgaatctgcatttttacataaaaaactgggcagagaaagccaatcagatacacatttgtctcaggtgaggagagggatgactttgggttctgtcctttgtcccccacctgtaaagataatctatcaattgccaatttatattgccagggtcaaattcaacagaactgttttagtgtaaagatcttgaggcccacaagaaatttcctttctgacaaattatgagggaggtatatagctttcgaaatctttgtagttatttttttattttattatttgggttttttttttctttattgacaaataattgtatatactcacagggacatagtgatgtttcaatacagaaaagttatagtgagcagagcaggataatttcatatcctttgttaaaggaaaataaatctccgggacaccccactaagccaaataatagttatcttatttagaaataaaatgggaggcaggtttgtttgatggagttcctagctgaggtgggagaattgcttgaacctgggaggccgaggttgcagtgagccgagatcgcgccattgcactccagcctgggcaacaagagcgaaactctgtctcaaacaaacaaagactatagaaaagctatttgtgaaaatgctttttgatgtgctgttttatgtcacagaatgcaacctgtgttttgattcagcaagttcaaaacactctttttgtggaatctaagaattgattattttgatcctattgagctttcataagaaaatatgaatatccagttgtaaaaactagaaataagctataagctatctgtggaatgctttgtgaggtgctgttttatatcataaaattgaacttgtgttttgattgaacaagttgaaattactcattttgtagaatctaagaagtaacgttttggaacttcttgagcccttattaaaaaatagaaatattcagtcctaaaaactagaaacaagccatccgtgcaaatgcattgtgatgttctgttttgtatcataaagttgaacctgtgtgttgattaaacaggttctgaacacttttttttgtagaatttatgaagtggcatttctgagcctattgagcccttatacaaacatacagttttaaaagctagaaacaagctatctgtcaaaatgctttgggatgtgctattttatgtcacggaatgaaacctgtgttttaattcaataggttcaacacattcttttggtagaatctgagaagtgacattcccaaacctctgaggcctttaaaagaaaatacgaatattttcctctaaaaactagaaacaagcaatgcgtggaaacgctttctgatctgttagtgtcacagattggaaactttgttttgattgagcaagttcaacgcactctttgtaggatctaagtagtgacatttccaaacctattgagcccttataagaaaatatgaatatttagtcctaacatgctatctgtgaaaatgctttttttttttttttttggcacagagtcttgctgtgttgccaagctggagtgcagtggtgtgatctcggctcactgcaacttctgcctcctgggttcaagcaagtctcctacgttagcctccctagcagctgggactacaggcgtgcaccaccacgcccagctaatttttgtatttttagtagagatgtggtttcaccatgttggccaggatggtcttgatctgttgacctcgtgatccgcctgcctcagcctcccaaagtgctgggattacagacgtgagccaccatgcctgactgaaaatactttttgctatgctgtttcataacacagaattaaacctgtgtttttgtgagacaggttccaaacactctttttgtagaatctaaaaaagtgatgtatccaaaccttttgagccataataagaaaacatgaatatttagccctaactgctggaaacaagctatctgtcaacacactttgtgatgtgatgctttatatcacagaaatgaacttatgttttgatgaaacagattcaaaacactattgtagaatcttaagaagtgacatttctgagcctattgtgaccttataggaacatacaaacatccagtcctaaagtctacaaacaagctatcttggaaaacactttttgacgtgcagttttataacacagaattgaacctgcattttgataaaaacacgttcccaactctctttttgtagaatctaagaagtgacatttcgaatctattgagcatttacagtaacgtatgaatatcttgtaataaaaactagaaacaagctatctgtaaaaacactttgtgatgtgctattttatgtcacagaatggaacctgtgttttgtttcagcaagttctgaactctttgtagaatctaagaagtgacgtttttgaccttattgagcccttataagaaaatacaaatatccagctataaaaactagaaacaagctatcagcgaaaacactttttgctgtttcatatcacaaaattgaacctgtatactgattaaacagtttccaaacactttttttgtagactcttaagaagtgatgtttctaaggcagtgaggccttatgggaacatatacataatccagtcctaaaaactagaaacaagctatctgtgataaccatttgtgatatgctgttttatgtcagagaatggtacctgtgttttgattcaacaactgtgagacactctttttgtataatctaagaagtgatgtcaccaaacctattgagttttataaaaaatatgaataaccctaaaaacgagaaacaagctatctgtcgaaaatgctttgtgatgtatttttttatatcaaataatggaaccagagttttgatgaaacagcttccaaacactctttctgtagaatctaagaagtgacatttccaagtcaattgagttcttacaaaaaaaatgcaaaatccagtcccaaaaaactagaaacaagctacctgtaaaaatgctttgggacatgcagttttatgtcacagaacggttcctgtgttgattcaacaagttcaaaacactcttgatgtagaatctaagaagtgctgtttccaaacctattgaacttttattaaaaaagtaaaaatatccatccccaaaaactagaaacaagttatctctgaagatgctttgtgacgtgatgttttatgtcacaaaatggaaactacgttttgatttagcaagttctaaacactttttctagaatataaaaagtgacatttctgagcttattgagctcttagacgaacatacaagtatccactcctaaaaatgagaagaaaaacctatctctgaaaatgcaatgttatgtgctattttacatcacagaatgaattttcaaacactctttctgtagaatctaagaagtgaaatttccaaacctgttaagcccttataggaacatatggatattcagtcttaaaaactagaaacaagctatatgtgaaaatgcattgtgaagtgctgttttatgtcacagactggtccctgtgttttgattcaccaaagttgaaacactcttttggtagaatgtaagaagtgatgtttccaaacctattgagcttctataagaaaatatgaatatccagccctaaaaactagaaataagatatctgtgaaaacactttgtgatgtgctgttttatgtcacagaatggaacctgtgttttgagttgacaagttccaaacactctttttgtagaatctaacaaagtgacatttccaatcttactgagcccttataggaagatgtgaatatccagtcctaaaaatgagaaaaaaagctatgaaattgcattgtgacatgttgctttatgtcacaaaatggaatctttgtttttattcaacactttcaaaactttttgtagaatgtaagaagtgacattttcaaacctattgagcccttataagaaaatgcaaatatttagtcataaatattagaagctctctgtgaaaatgctttgtgatgtgctgttttatatcacagaattgaacctgcattttgatgaaacagcttccactcacttttttatacaatctaaaaggtgacatttcctagcctcttgagcccttattggagcatatggatatcctgtcttaagaactagaaacaagctagctgagaacatgctttatgacatgctgttttatgtaacagaatggaacctgtgtttttagtcaacaagttccagacactctttttgtagaatcttaggaagtgacattttctatttttattgagcccttataataaaatattaatatttagtcctaaatattaggaaaaaacctacctgtgaaaacgctttgtgatgtggtttcatatcacagaattgaacctgtgttttgacaaagcaactttcaaacactgtagaatctaagaagtgacattactgagcctattgagcttttataggaacatacaaatatccagttccaaaaactagaaacaagctcttggtgaaaacgctttgtgacatgctgttttatgtcataaaaatggaacctgccttttgatgaaacagcttccaaacaggtttttttttagaatctaatagttgacatttctggccctattgagcccttatagaaacatatgaatatccagttctaaaaactagaagcaagccatctgtgaaaatgctttgtgatgtgctgctttttgtcacggaataatacatatgttttgattcaacaagttcaagacactctgtagaatctaaaaagtgaagtttttgaacctattgagacttgattaaaaaatacgaatattcagccctaaaagctagaagcaagcaatctgtgaaaacactttgtggtatgctgttgtatgttatggaatggaacctgcattttgatgaaacagcttccaaaacacttttttgtagaatctaagaagtgacattttggagcctattgaacccttacaggaaaatacgaatatccaatcctaaaaactacaaacaagctatctggtaaaacgctttctgatatgctgttttatgtctcagaatggtactggggtttcaattcagcaagtttgaaactttctttttatggaatctaaaaagtgacatttgagaacctattgagccgttataaaaaattcaaatattagccataaaaattagaaacaagctagctgtgaaaacgctttgtggtgtgctgttttatgtcaaagaataatacctgtgttttgatttggcaagttcaaagcacttttttttctagaacctacgtagtgacatttacaaatctgttgatcttttataagaaaatatgaatatccagccacaaaaactaggaaaaatctgtgaaaatactttgttatttgcattttatgtcacagaatgaaacctgtgttttgatgaaacaacttccaaaccctctttttgtaaaatctaacagtgacacttatgagcctatggagcccttatagaagcactcaaatacccagttttaaaactggaaactgtctcaaaaacactttgtgaggtgcttttttatgtcacagaatgaaacgtgtgttttgagttgaacaacacacaagtttccaacactcttgaatctaagaagtgacattttcaaacttgagcccttatagaaacatacaaatatccagtcctaaaaacaagcaaaggctatctgtgaaaatgctttgtgatatgctgctttgtgtcatggaatggaatctgtgttttgattcaagtttgaaacactctgtagaatctaacaagtgatgttttgaacctattgagtcattataagaaaatgcaaatatttagccataaaaatgagaaacaagctttttgtgaaaatcctttgtgatgtgttttctatcacagaattgaacctttgttttgttgaaatagtttctaaacatacttattgcagaatctatgaagttatatttctgagcatttgagcccttataggtacacatgaatatcagattctaaaaactagaaaggagctatctttgaaaactatttgtgatgtgctgttttatgtcacaaaatgataaccatgttttgattcaaaaagtttgaaacactctgtagaatctaagaagtgacatttctgagcctattgagcccttagtaaaaaaacaaacaaaaaacgaatatccactcctaaaaaccagaaaaaagctatctggtaaaatgctttgtgttgtgctgtttcatgtgacagaatggtgcctgtgttttgattaaacaagtttgaaacactttttttttgtagaatataagtagtgatgttttagaatgaattgagcccttataagaaaatgcaaatatttaaccataaaaataagaaacaaacaacctgtgaaatcactttgtgatatcctttttttatgtcacagaatggtacctgtgttttgatttaacaaatttgaaacacactttttgtagaatctgagatgtgacatttacaaaccaatcttaagccagttagatactctgatgagccagctgtgtgtgtatgtgtgtatgtgtgtgtgatctttgattattaaaactgaaaaaataatcgtatattcatgactagtagacacagtgttttaaaactgattctgaaagatttgagggttaggcttgttttaaaaacaattgcataggtcctggaaacaccaagaattagtggcttctcattcctagtcacatgaaaaatattttactactcttgtgaatggccataaataatatgcagaattttttctgtgtcctaaccttttatataattggttctacagtgtacatcactgtgtgcaactttgttttgtgtgctcagacttacattttccagttttctccactttgatacaattggtctgtgtttcatacattttgtattttctatagcgttcctttatatgactctaccacattttattgagtctcctcatgctgacaggtaagtagatgaattaataaatgaatgaataaataaaaatgagagcaaatttcaaacaggtgattaatttagtgattgtaaccatggactcagcaggttagaaataaaaactgaaagatttagaatgcaagcaggcacatcataccttctaatagccattggaactatgacccacaaaccattagcctagaatgatgggacatatcttgtctctaaaaaaaggtcactgttcagttctcaaagaatggatataaaaatggcagataccattccacattattctacttcctttaacctctacgcataaaacttgagctgcagggaatgttacctcctgttcttaaaaagacttgtagttcagtgaggaactcactcctttcttcattcatgtgttcaaataatatagggaaatgaatggaaaagtgaagagaagttgaagactattatggggatagcacaggattagtcagcctcatggtattattgatctgccttattccacaaatatttaccaagcacctgctacatgcaatttgtatactaggtgctggggatacaggagataacaaagtccctgctgtcaatgaaaggggtcagtcctttgattcatctttagttaattttaagcacacaacaactatctcaaactttcttcacactttccaagctcccgatccttcatgcactcttggtagatgcctgaccttacctcttaccttactagaacctaagaccacctggtataaaatcccttaagcacactcagatttgcgtgattttacaatgatgtctgttcccaaagcatcctcacttctcttggagctgagggtgaagagctcctctttcttcccatccgtgatcttggaacatgtacgactacacttgtgacagtaaatgcttaatacaggcagaaggtttgttccttatttcctccctggggcctccctccagtgaatatctcttctagcattgtcagttgtatccaacagaaaagcagagatctctccattggtccaaaaacctaagatggactctcactgctaaacttctcaaatgaaaattcctccactttagtcctgattaccactcaaacactgttagactgggcaggtcactacccctgcctagttctgtttccccatctacataacagagaaataattgcgccttatctatcctacagaagtgtgaagaggtttgatgtgacagcagtgaaagcaatttaaaaagcacagagtgctatacataagaagacattttcataattattccgctctaacatgatatctgtattcatacgatctcaaagtacttacccaagcatggattctaactcttgtgtatgtaagcaaaggtgtaagtctgtcaccctccatgcaaatagaatctcccctcccttggcccctgcatctcaccatatacaggaattaactcaagatgaatcaaagttttaaatgcaagaccgcaaactatgaaaatcctttaagataacctaggccatacccttcttgacaaaggctttggcaaagcatgtgtatgtctaagtccctaaaagcaatagaaataaaaacaattattgacaagtgagacctaatacatgaaagagtggctgcacagtagaagatattaccaacagagtaaacagacagccttcacaatggaagcaaatgttcccaaactacatctgacaaaggtctaatatgtacgatctaccttaagtccttaaatcagatcaaaaagtccaattaatggttagagacatgaatacacactgctgaaaagatgtaacagccaccagtaaacatgaaaacatgctcaacctcgttaatagagaaatgcaaatcaaaagcacactggtcaaaatggtgattataacacagtccacaagaacagataccagcaggacagaggagggcactggggcaattgatcatgattcttatggatagtcatttagtgttattaatgaatttcataacaaaatgatcaccatacaaaaaatacaaaatgtgttttcttccctgagaaaggaaaataaaaacttggaatgccgattcactatgccaaaaggaaaagttaagctgaaagctgagtcatgcaagaaactgcctttctttttttttcctgagcagacagctactgataaatagttaaatttctccacaggtagctactctatgttcatctcatcttacttaaagtgctgatttactgagcaggagaaaaatatataactgactattcctttacctgtttgttttctcttgcaacatgtggattcagcaacgtgaccatactctccctcttttccccgcagcctgcttttctcttctaaacactgaaaccctaaaatatttttggagaaaggcacagacctctgtcgcccagccatgtctttaaccttggaagaagaaacttctaaattgataagagatctgtctcagacactttttcgtttacatcccgttatctcagaaagcaaaacaggctttgttccaacccaaagtaatttgtgaatattcaagcggtatcattctgatgtaaaatttacataaattcttgggtttaccaaaatgcaaatgggcaagcagatcactatttacagataatggcctaaaaaatggtaagagtaaatgctgtggagctaaatgtttctgagtctgccatttcctagttttgtagtttctctcgggcaagttacccaaagttgctgtatgttattatcttgacatttaaaatagaagtaataactttattataaataatagttaataccatagggtcattaggaaagtgtctggcatatatagtcacaacccagtgaatgccattattgtttttgctattatcagtataataattgatactaattttgatgctgaggtaaaataatatctggcagcttttaatttgctaatgttaaataactgaaaatagctttaaaaagtgaaaatatccaaatcaatgacaatatttgatttatataaaataagcttcattttttttagtttttttgctcctaattattacttcactcatcacactgatatctgagcactttttaaaacatatccacccttctcagttgtactacttattcccttttcttgtaatcccagccttcaaagatcctttctcatttttctaactcatttcacgactccctcaccttgacccccagttatatctctcttgaagtcaattccattgaattgactacttggcccaaacttcaccccaactcagtctctcttcaggaaggaaagtccccacacaaaaaggaatgtgtctttcaactcatgcgccctttttgaagaagctttccagacagcttccttacagtgatctccgttatccatcctttagatcgctgtggagtcctacaggggcgcaatgtggacagtcattcaaatgaagcacacctaagtgcttgcattttctaaaggcccattgattcatgtaactcccgtacttgcacagataagatgttcctgcctgaatgcagcagatggaaatgaaaattgtattctctgtcaaggctgattgtattacagcttaatgatttgcattttaaaacttggaagttctcataaatattaaagtgaaagaacaattggctacattattaggtaggttcggctgttcgtataacctggtgctaactatctaacctgcctgagtgagcctcagtcttcattactgcagcatttgtaagatatcaatgcctgcttgaactcatgtcttactaagattatggccaggattgagtaacatatggatataaaagcacttgacaaatcagagtatttcataaatgtaataataatatgctacatttataacatctatactcttttcctgtgtctatcttcatttaaaccttgcagtttctatcataatcaaagattttgtaatcaggttacaatgagtaggatttaacccataagcaattttcaaatttcctagatatgttttcagttttcacatttatgttggtgacaaaattctgttttcagttttggtgtttgcatcttctaaaacagtgtcttgggtacttgctctttgatgagacactgtgcagacataaagagtgtaagaaaacagaacagtttatctcagctttttgtggtctagataacctgcacactgctttcttggctcactgcaacctcctcttcctgggttcaagtgattctcctgccttggcctcccgagtagctgagactacaggcatgtgccaccacgcccagctaatttttgtatttttagtagagatggggtttcaccatgttggcccggatggtctcgatctcttgaccttgtgatccccctgccttggcctcccaaagtgctgggattacaggtgtgagccaccgtgcccggcctgcacactgctttttaataagctgatctgtcttcttgtttacataggctgtgctatagtcatttaaagttcaaaattactgctaaaaagtaattaatcctttactgaaatattcctgctatttcatgagctgtcttacaatttggaggaatctatttgtcactgatgtttaaaaaagaaagtcacagcagggaggctttagcttcattgaggaacattattataaaataaaatgatcgagggtaatttttttttgtccttgtggtactgtttctgcagatctacattaatctgagcatttaaagtaataataaatttgttatatcctctttattattcacttcaccatggtagcccctagtggtaaaaggagatgtaaattgctcagtgctcacattgcagggaattttttcctcagttgaataaaaaggagttaagcctctttggaaatgagggctatagcctgtcaataactacatatattcctgtttttaagaaatcagaattctggtgtccagtaaatgtagatgccagcattattaaaaagtgattgagcagagaaatgaattgaatttttgacccactctggcttccagctttcatgggagcctatacagggggatgatgaagagggatataagagaataaatgattgctctattaatctactttaattgatactaaaatctgacagcgaattacaagttccaggcagtaaggcttaccaattcattggtaatttcaaggttctactttgctttctttttgccttcagctccttgcaaaggacacctttttttttttttttttttttgagatggagtattgctcttgttgcccaaattggagtgtaatggcccttaacatccgcctcctgggttcaaatgattctcctgcctcagcctcctaagaagctgggattacaggcatacatcaccacgcctggctaattttgtatttttagtagagatggggtttctctatgttggtcaggctggtcttgaactcctgaccccaggtgatttgcctgcctcagcatcccccgcccaaagtgctgggattacaggtaggagccaccacacctggccaaggacagccttttatagttcagtttctcagtttatctttgactattcttaattaagcttgacctggttctccaccactgacgctattggagttgcaaagcattttgctgttataatgatagctcccttgatggctgttcattattaactggttttcaaaagtgctgcttttaactttcattttataaatatttaactcaatttttataaaatgtgcatagactatagaggttctgcttacctgtttaatacagtaaaaaaatcccttttgtaatcttatataatattaagaatgtgtccttaattcatgcttaacataaattcttacacaactagcagtatctcaaaaaataaatgatttaatagtttatgacccttatacatataattaattgtagtaaaatatcttagaaaatagaatgagtattttttataaagataaaaaatcctgatttttttttctggtcttaatataaaattaaatgtgttaaagggaacttataaattacatagtagttcattgctcaggaaaagaaatgacaaagtaattaagagtgtaaaattaaaaggattaatttttcttaaaggccgatgagttaacaacacgcatcaatctctcttccttctccaaacttcagacaaatgatggcaaagtaatttttaagaagtcaatttatagaggcaaaaaacctgaagtacagagagtaggaaagacagtaatagaattgagagcagttgacatccataacattcctattattacctccattttctggataagaatatggagaagaggaatcgttaagcaatttgctgattgtcacatattcagtaagtggcaaagttagtattgaaacccaagtagtcttgttttaaagtcatacactcaatcactgtgccataattcaataaattgtgaaggatgggaagcagatggagaagtgattgatgaagcaggactgagaaagtgctgcctatgtgcccacagtgtgaagaccctacaagacatcagaacatcatccagtgaagctgtgagcagctcaccacttggaaaaactgagtgttttggaaggcagggataaagtgcagttctgaaaagagaaaaatccatcaagttctaaacggtcgcgctctcttaccccacagtgggcaatggtctctccattcatcattttcttttccctgagtcccttgaatcttaaatatactattctgtgaattaaacatggtaaacattagactttgaccagcgctattatcagaagttcacatacctaatcaaaggacctgtaaccttcttcccctccttagtttctacaccaccagtagccaattatactatcccagctcccatcctaaaatccccttctaaaatagaaggcaaaagatcatcagtcatttgagcaaaatttcagcatgacagcatgagtagttgagacctatagtaacaactaaaatggactgggataaaacaaataatgtttggaatcaaagaacaggaaaaatacaaccgatattggagcaagaaaaaataaaaaagaatatgaaaaatagataagaaatagctattggaaaggtacaagaaatacaattttaaaaccagtggaacataagacaaaccacaaaatgagaaaattctattaataaaaggtcgggggtcggggaactgtattctttttttttttttttttttttttaagacagagtttcgttcttgttgcccaggctggagttgcaatggcgcaatctcggctcactgggcaacctccaccttctgggtttaagctattctcctgcctcagcctcccaaatagctgggattacaggcatgcgccaccacgcctggctaatttttgtatttttagtagagattgggtttcaccatgttgatcaggctggatggtcttgaacccctgacctcgggtgatcccaaagtgcagggattatgggtgtgagccaccgtgcccggccactgtatcttttaaaaatgtaattgtcatggaaggcaagaaaggtttaggaggctttccatattgaagaggactgaggagacatggcaactaattgcaatacatgattctagactgcatgcaatactggaggaaaatcatgctataaagaattgactcaattgataaaatcagaatactagcagtagattacatcaaagtatcgtatcaatgttacatttactgaatctgactaccatactatagttaagtaagagaatattcctatttttaggaaatacagaagtgtttagaggtaaagggtcatgatatatacaacttaacaaaagacttagacaaatatggggtatttaaataaaggagaatgacgtgcaatctgagaacaagaagtccaacagagaaaagcaaaaatagggagtcagcgagcaaccagtgagatgggagcagaaggatggaagggtggaggagtgacatctaaacatattaagaactcaaatatgttgattattttgtatatctgaagtttgaaattatcactgacaatcttctaaacttcaggaaaaatgaggatactgtgctacaaatgtaaacttaagaacaatatttacatagtcatcataatgtaattatgaaatactgatttcaccaaaaccaatttgatttaacacatcgagagaacagtgggaatagagtcctgtaattggtgcacctgtcctaattcctatgtaggtattataatagaaagttaataggtaatgtttaaaattgataaatcaagataacaatatcagcatgttaggttaaaaacaaggtaattaccaaaagcaccagataaaagagccaaacattgctttctctattgaacgggactacagcatagagaagtgttaagcaagctgccattattcttttgctcttattataagcctcttaatactatttgattactagctcatgagctcctatttataaaaataaaagcaaattttcgaagtcagaacaattcatgctgctacaaaatccctaaagtcatttcaacaatacagcacactgatgattatatagacatttttcttgtctgagttctttgtctagaaactttttaaaagaaacgtggtcctgtattacatgtagcatgctttggaagaaaaactatctccaatcaaaaagtttttaaaagagcccagatgttatcgtcctttgtatctctaaaagcaattgcttttataaaattaggatctactcttttttgaaatttgaatgctgaagttttgtgggtttcagcaaaagataggcataacatacatctctacattttattaaatatgatggtgcagatgttaaaaatatgtttgaaatgcagtaccttctgttcttgctttcaactcctaccctagagtaaatgaaatgctaatcacctcttgtgttagtgatagaatttgtgagtttccacagataaaatatgtttactgtaatttccaaatagttgatagccagtagcaatatcttgacttcagcaactggtatgtaagggtctatattaaagtgtttatattatgactagtataacagatggtattatttgttacagcaggtcataacactaaaaaataaaactattacacatctacaatttgatcacaaattttagtggcagtgatcacttattttatgaaagagaggcagtaattgccgaagtactgcctaaaaatgtaagacaattctcattacagggtaaggtaaaattattgacttattaaccagaaattcacatctatcccgctacaggaaaaaaagtgtacatttaatatctactacagtcagttgagttttcaaagtaatctgtcatctctaccatgaatatggggaacaggagaataactgctggatttttggcatttgacacctaatatatagaactttaaaggaggttatctattatataaataatctttgaagaagagcaatttatgtttttggacaaccaaaaaattacttgtttagcttcacaggaattttaaagcatgttttcacttattattaaacagtaacattgaatatactgctcttttatcagttctcatttttttcaacattcagtagatgactttaaagaactctcaccttcctggttttctttctaaactgagattatttcttctctcacttatgcacctattttctaatggccatgtctcaaaaaatttttattctagcgtcttttttccttttatcttggttttgctgtagtgctagatagatggttacttgtgagactttcaaatctatataccaggctccaacttctctccctctccctctctttttgagtaagggtttggctccatcacccaggctggaaggtcatggctgattgcagctttggactcctgggctcaagggatcctcccacctcagcttcctgattagctgggactccaggtgtacagcatcatgactagcaattccattgtttttagaaatggggtcttgctctgtcgaccaggctggtctagaactcccagcctcaagcaatcctcctgcctcagcctcctaacgtgctaagattacaggcgtgagccaccacacctggccaacttctaagtttcagtgctgtagttttaaattgtttctcatacttatctaatattttttcccaccatgtcaaacccttaaaaactcagtatggacaaaataaatattaacttttttgagattgataattgtatgatagtgcttattacctcaaaagaattactggggcagcagtataatccagtagatgggggaaatagtggatattaagaccgaaatgggatcataactttttagttgtatttgcccacattaattgttttaaagggggtaaaggcctggaatatgaaaacaggaggatataaaatatatggaggttgtgaaagatgactcagaacttgaaacaattgtttcactgcagtaaatacatgttgaatgcatagaacagagaaaaacagaagaaaagaagaaggaaaaacaaactccatgatttaaaatattgatgaatgtgacaataattgtatctttaaaataactgagaaatggtagaaataaaaattataagcttcaactgtatattacttattcttgacaaagatgatagttgcaagctgaagccaaaatttctaactaggactaatgcaaagatttcaagagaaactttaataaagaattattgatgcaagcgctttcagaaagcaaaggtagggactaaccattagctcttgtttagaaagataaaggtcacaaataaaatttgtgttttaatctatacattttcagcattatgtcatcataaatttgcatgttgtttattacaaatgggaaaaggtttcctgtaatatatcaagatgagttttaatagtttcaaggaccattgatttgtaaacttaagactattatagtgttgtggaaaattaaatataattggtgttttaggaaaagttgttcattgaagtttccattttatgtgccttaacagattaattttgcttattaattctgtgatatttaagcactgctgtaagcttcacagatttggcaatagccactatatacttaatgagtacaaactatggagtatttccatattaaggtagaagaaatatttaaaagcacttctacttgtgatgtcattgggggtgcaacacaatataaagtacgcacattgctggaggagaagcataaaataaagaactcacggggcagaaacttaagacacacctaaatcaaatctttgttttcagcattatctttcattactattctttgttacaaaaaaacattgctatctgtccttttctatatgttctctacattaaaacttattatttgtatacatactgttccctacatctgcagtgccattcccagctcacatatctgccctcttaaatttatatcaaattcaactcccttcaaaaagccttctcagttgctttaacccaagccagtagtctgtcttctagaaaacagttgatgccgatgcctccttttcctttagcaactgaaaataatattatagttatttaatgtgtgtgtgtgtgtgtgtgtgtgcataacatcatactatttagtagtatctatatctatcaagtatctgctacagtggatgatagatgacttaaagacagaaatatgttattcatatctacttctcacaggtctagtgctgttgcaggatattttttaaggaatcagagagactgatggggttcaggaggatatttattatttaggtgcaccagcccagtcggattaacatccaaaggactgagccctgaacaaagagttaagttaccttttaagcattttgtagggtgggaggagatctgtgcagggggaagcatgttagagaagtgagaaacaaagacagttattcaattaattgagaaatgcgttacatcatttcttacttttcaaggaaaaacatgttttgcgacttttgtttatgtgtctagtgactttgcagctgcccagctagggaatcagggtcttcacaatgcctgggaatggaggggagagaaagctcattagccacagaaaaataggccgttagttttttaaaggactctagctctttctctttctcagggggaattggattttcttacatacaactgaggttctgcttacacattctttaatttcttttaattcctgttccagtgcagtgcaatgttcatagtagatgcttaatattttttgaattattgtatctttagtcattgcgagccatcattttgagagtcagtctcattcttttagccctagattatttttattttcttgagatacgtgaataaagggcacaggaaaaaaacacagttgagagttttggataatagtaacctaattcacccagattttacttcatattggttggaactctaagttgggtgcaactaacatgagacttgttttgatttattgtaaacatattcttgaatgactaatgaacagtgcttcatgtgaacaaattttcaccttctgataatttccaatattacactttgaaaaacattcccattgtagtgctctagaaaatataatttcaattgttaaaattcaatattactgtaattgaggatattaaataacttgttgttacatgatgctagctgcagcttaaatttcagatcatgagtgttgttaatattatatagttggaattagttctgagatcaatgaatcaatgctgtcttactgttttgtctttaatttttataccacatttattttgtgagtggatttcataaaaggaagttgctttatgttgccaagctcattatcttgggtttttgtccagagctgaattccctttttcatcaaaggacagagagagcccattataaactattgagtaatgctgatttgatgggtaggccacttacctttaagtggaaaggaggccaggcgcggtggctcacgcctgtaatcccagcactttgggatgctgaggagggcggatcatgaggtcaggagatcgagaccagtctggccaacttggagaaaccctgtctctactaaaaatacaaaaattagccgggcgtggtggcgggtgcctgtagtcccagctactcgggaggccgaggcaggagaatggcgtgaacctgggaggcggagcttgcaatgagtcaagatcacaccgctgaactccagcctgggtgacagagcgagactccttctcaaaaaaaaattacacaaaaatgttagactaataaatattaataaacactaaaggaagaaatttagtggaacatttatcagaggcaacagaccaggaagttatagttaccctgtgaaaaggcatcatctaggattcatagaaaacatttgcaaattggcaacaaccaccaccacaacaaactaaaacaaatgaaagaaatagacatttatacagggaaaatataaatagataataagtgtaataaattttgtgactttccacttgaaaacaaagaaatggaaataaaacctatgtaaagaagtggtggagtgagccgagctggggtgggaggggtgggggcatcccaggcagagggaacagcagatgcaaaggtctggaggctggagcaggctgtgaggggtgagagcagcaagtacatgaagtctagaccacaaatcgatgcttcaccctcaaaaatagcctctcactggccaccactcaggcccagatacatgtgtaaggtgggcagccttcaggaaaagtgaccgcaaaagtgcaccacattgggaattctgaggtgtttgagaaagttatggatgaagggtgaggtagactctagtggggaatgtcctcttgccacttggacttctctgtctatttcatgggctattatcaacttctaaagagccagtggtttgggtgcacatttaggtgtaagtacctcttgcctcaagccttaactctctttccaatgagtcaagtgagctgttgtgtttaagtaacttctctttattgtgaaatctttcctatcactttaagaaccttcttcttcagacccaagtaatcccaaggcacctataatgtccctcctggagaagacaaaagggtgtcttctatttctgtgtggcccgatatttcagggcccctaaccaggttagttcaaggtgctcagcataaccatgaatctgctacccatgtttctcaggtgggtcataggccctggagggattgtggctgtggaccaagcagggggtgctgtgggctgttctgagaaggagggttttggagtgtccaagctgagaacatagaggccccagatgttgtatgagtaaattttcatctgacagaattatattttcctaactgaaaacatgaaacagagatgtaacaactgtgcctctttggctctgtctttgcatgctgtcatcagccactgaacaggagctgagagggaagacataaagaacagaaaacccatgagggggatggtccatgtgggtgtggaagtgagggtgagtggggatttggccaaagaggcctaatccacaggagtagagtctcatgtgtgactttcagaatgagcaggagtgagataggtggagggggagtgttggaacatctcatcagaggtgagaatccatagaaggagacactggtcattacagtcagtgagaaaagtgactttagcctgagcctaaggtcattggatcaaggaaggggccaggaggagctccttgaagggaagctgtgagcttgagaggcaggctgaggcagatcagtagaatgagcccccgagaagggctcacagagtcactgaaggactgtgaggtggcagggacaagctcacatggcctttggtcagtgagtctccagctgtaatgagaatgaaatggggaagatctgggacaggaagacaagctgggggcgctggtaccatcatggggagatgatggtgggtggctctaggttagttagagttggaatgaagagcagaaagcagcttcgtgatacctttatgtcataaaatacatttggcatggagaggacttggactttgtgcatgaaggatatggatgtttctaggctgactcccaaatgtttctaggctgactcccagaaactaggatgtttctaggctgttcctggctgagaatttggatggtaactatagtccaaagaaacaaagaacactgaaatcatatcttattttttttaactcacaaaatagaggcaggtagatatttatatgtgttttgttggctcaatgattttttttagtaataaacatatttacttagaaactactgggtgtctgtatgctctgggatttttttctcctgtcctgatgacatctctttcctttctctgggttcaggagttacttcccaggttgtggtgacacaggaacattcactttccacaactcctggaggggcagtcaccttcacctatggctccaaaattggggctgtcatcagagcatctcgacagctgggcccaacagaacatctggcaatgtccccagggcaatggtgggcacaagcagtcaggtcctgggacccctgcacaatcccctggttctcttcatgaagaaaaagccactctggttataatgaggactagaccaagaatgaggcccagtgttacatgctcggtgtggtgatctgaaatatcaccacagggacaaatacaaaaatacaagtgggaaactacactcaaacccttggatcaagcctcagtcctatgcttctgaagcaaatttcttgtttttggagtctggttttcaaccactgtagactcagatcatttattcttcaggcccccaatgggatcatcacaagcactttttctatcaatcatggcagtcacttgagatcaaaggtgaatttcttcttcctcaagttataagcaacactttggcatatttggtgaacttcaaagaaaatggctaagatagaggatgagagacataagaggcttcaggaatatttcagcagatgcaaagcagactacagggtaactcatttcccatatgatttgattgattgcaaaatgtgaaattaaatgcatacaaaggggaatgtgtgtcatttttcctcttaatgacaaagtaaaaaaaaagcaataaaacaaaaacaagcactatttcatgtgtcttgataaacttgtagaaagtcttataatatccacaatatctaggatacagtaaaataactttccatatgaagaaccagaagaacacaacttaaatgagaaaagacaattgatagacaccaatactgaaataatttaggtgctgatgttatgtaactgagattaattaaggagtaattatacaattccttcagtgagcaattttagacattattttttgaagttttaggttcaggggttcatgtgcaggtatgttacgtaggtaaacttgtgtcagaggggacattcttgaaacaagtggaaaagaagcaaatcccgaaaagaaaaataagtcatagaaacaaaccaaattaaaattagaaaacagaaaaatgcaataaattaaaaagaacagtctggagggactctggaacaggtaacagtgaaattaaagttcaggcattagaggaattatttaccgttaagtagggaagaaagtacaaacaatagccatctaagcccagcagagggagctgtggatcttctcagaggtgagcaaggccggaaatgaactcccggggctctcatttatggctcctgggtccatactcactggcccgaattggggtttagagcaggtgctttctcccaaagggcaaactcagagttcccagcagcccatcctccctgacagagcggctgctgcctggctgagcactcagaacttagggagccggtggttttggtagaggccccatgtttgcataatgtcctaaccaaacacacatctacccggggaggtgacgaggagttagaggaactgtcccagggtccagaagtagccgggggttctggggatccttggaaagtccacaccatagcttggatgtctatcctcccctctctccctcctcactgcccaggttcatgtagatttcaaagacaggactttggagggatctgtctgctgtgattcctcacacataacatgtatctgttttagtttcttggttcagttctcaggctgtggtgactcaggagccctcactgactgtgtcctaaagagagagacttattctcatgtgtggcttcagcaccacagcactgaattcagcagaagcctggtcaagtcctcaggacattgatgtgtaacacagataacaaacacccctggatgcccacttgattctctggctccctcctgggggaaagctgccctgacccctcaaggggcccagcctgaggatgaggctgagtatactgtgggctacaccacagtggtccttagcacagtgagagacccagatggggaagcaggacatgaacgagcttttggctgatccggggtacaaacatgaacgtaggatatcaggatcacgtggccagacacctgagctctcaaggacacctaaattttaactatccgtagagagaaaggtgggtggagaggtgtaaattgattcctgtatctgtttgaattttaaagtggaaaatatttgtgaatcatttgggagatgcagattcccaaaaagaagaatttatgtttatattccaaacagaacagtaatagtgagatcaactctaaagactaaggtcaaacacacttcatccagaaagatggatctcaaaagattttgttgttgttttgcctattaaaagctaagagaggaaattatattaataaagtttatttcatgttctatgttaatagtgtgtatttcatagctttttaagcattaaaaattataaaagtgttaagagggattctcttctctaatgttatataagaaagtatccacctaggaaaatattttgaaggtctaacccccagtacttctaaatgtgaccttatttttaaaatagtgttattgcttatgtaattcttaggatgaagccatcctagagcgaggtggcctcttgatccaatgtgcctggtgtccttataagatgatggtagtaaggagattggaagacacagagagaatgccgtgtgacgacgaaggcagagattgaatttacacagctgcaagataaggagcactaaagattgctggcaaaccaccagcagccagaaagagggaaggaaggatctcccctcaggtatatatggaaacattgccctttctatgaattttgggaggctagcctccagaactgtgagacaatacatttgtgttatcttaaccaaacttgtgtttaatacattctgacagcagttctaggaaaccaatacaccagacaataaattacacaatacttctgaaattgattgtacttctttcattttggcaaccagtttttccatgaatatgattatatctgtgctcatatttctaactttataaatatgcttgtaatttaaggttaagataagaaatccttgtgtcttaaaaatccctaaatatatgagaactgaataataatattaacattatgagatctaatggaaaattgtagcttttacataattccacttgttcactagtatcaagatgtgaaggtgggaagatcaccttgttattaacaaaacactcctggtcatctctgtggatttgagagtgcagggggagacacctacatattgtttgggaagtcacaaatgcagcatgcccagagcatcatgtacaacagtgtgagtttgctggacatgtgggcaggaagcagaacagactggggcatgaggaaccacctatcaccaaacccaccagcgccttcctccctggatcagcccagagctgctcagacttgaatgtgcacatggatcatgtgggatcctggataatgtggattctgatcagtgggtctggactgtggactgaaattctgcgtttctagaaggccccttcttccaaagatccacatacatgttttaatattaccatattcataagaatggtgggaaataagggaagccactttcagacagaaaccaaatagaaatttatctgagagggagctaaaggattatgatcaaagagaaatccccaattccaggcagggagctgatcacagagggcagatgggaagttgggagaggttctatttttttttttttaagaaatagaaatgaatgcaaacacaactcaaacctcctcttgatccaacatccctgctggctcctgcccaatttctgcactggcttcttctccagtcttttcccaagcatggaccctcctcaccctctctgcttccccatctcaaactcacaacttcccttctcagttctcctgtttctctccctttcattccacttccttcttctctgtgacctccttagacaatcaccaaaatatttctagaagaaaagccatgggtatttttcatcttttcttgaaagttgtcactcacattccctcttcgttcttcagcctctcttaccccttactacaaaagatgcctgaggccactgtttctcttttccatcccctcaaatagcttctccttccaacccgtttctctcctcagttactagagcattcagtgaagcactcagtcaggttaaaggatcctcccaaatgctcaccctgctctctatgtgtgatctcctgaagaatcaagtagggagagaaacatggcttcatgagtttgtggggaagtgggtgcatggctgaactgtccttgttctcagcaaatgtactttatttcatgcacagtttgtatatgagacaaccttctcctgcggactccttataaaatgggaagaattatgtgttgtgttttcacagaggaagcccaaatattccatgctcatgggtaggaagaatcaatatcatgaaaatggccatactgcccaaggtaatttatagattcaatgccatccccatcaagctaccaatgactttcttcacagaattggaaaaaactattttaaagttcatatggaaccaaaaaagagcccgcatcgccaagtcaatcctaagccaaaagaacaaagctggaggcatcacactacctgacttcaaactatactacaaggctacagtaaccaaaacagtatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaaccctaagaagaaaacctaggcattaccattcaggacataggcatgggcaaggacttcacgtctaaaacaccaaaagcaatggcaacaaaagccaaaattgacaaatgggatctgattaaactaaagagcttctgcacagcaaaagaaactaccatcagagtgaacaggcaacctacaaaatgggagaaaattttcacaacctactcatctgacaaaggggctaatatccagaatctacaatgaactcaaacaaatttacaagaaaaaaacaaaaaaccccatcaaaaagtgggcgaaggacatgaacagacacttctcagaagaaggcatttatgcagccaaaaaacatacgaaaaaatgctcaccatcactggccatcagagaaatgcaaatcaaaaccacaatgagataccatctcacaccagttagaatggcaatcactaaaaagtcaggaaacaacaggtgctggagaggatgtggagaaataggaacacttttacactgttggtgggactgtaaactagttcaaccattgtggaagtcagtgtggcgattcttcagggagctagaactagaaataccatttgacccagccattccattactgggtatatacccaaaggactataaatcatgctgctataaagacacatgcacacgtatgtttattgtggcactattcacaatagcaaagacttggaaccaacccaaatgtccaacaatgatagactggattaagaaaacgtggcacatatacaccatggaatactatgcagccataaaaaaggatgagttcatgtcctttgtagggacatggatgaaattggaaattatcattctcagtaaactattgcaagaacaaaaaaccaaacaccgcatattctcactcataggtgggaattgaacaatgagaaaacatggacacaggaaggggaacatcacactctggggactgttgtgtggtggggggaggggggagggatagcattgggagatatacctaatgctagatgatgagttagcgggtgcagcacactagcatggcacatgtatacatatgtaactaacctgcacattgtgcacatgtaccctaaaacttaaagtataataataattaaaaaaaaaaaaagagagttaaaggctgagatgaggtaggaggctgccctgaggaagggtctcatcctctggcatctggtcacagacacgatgggcctgggcctgggctgcagagagcacaatggggctgctggtgggggctctgtgcggctctcagctgggaaataaagtccatgaactttgttttgcctcacggctcactggggccagcagctgggtcctctctgggtgcttggggagcttcaggccaagctcagcccaggctgactcctcctagtagtgtcacccagccacagaggctgtacacaggcccagggagagttaggttaagcaggggaagaggagcacatttgcatgaagggcccctccctctcctttgaggctagagggtggataagagagacctgcagcgtggctgcctcagcagagctctggggagtctgcaccatggcctggaccccactcctcctcctcttccctctcctcctccactgcacaggtcaggaggaccctcagcatcctcatgccccagctcactgacaccatctcccaaactcataccagaaatgttgtttgctcttgtccttccttcaggccataatgagcgtctctgttttcagggtctctctcccagcctgtgctgactcaatcatcctctgcctctgcttccctgggatcctcggtcaagctcacctgcactctgagcagtgggcacagtagctacatcatcgcatggcatcagcagcagccagggaaggcccctcggtacttgatgaagcttgaaggtagtggaagctacaacaaggggagcggagttcctgatcgcttctcaggctccagctctggggctgaccgctacctcaccatctccaacctccagtttgaggatgaggctgattattactgtgagacctgggacagtaacactcacacagtgatacaggcagatgaggaagtgggacaaaatcctcaacctgctgaggctattgttcagtgacaatttttaattttaaaacattttctgtatgtaaaaaatctatctggatgcatcctctgatttagaacaattttactcacaatttcccatttaatgtttcagaagtctcagaagaaattaaaacataaacaagaacataagcctcctgatgacactgagatgtctgcttatccttatgggctgataccaaagtctgtgaagctcaccttttctcttgaaagaaaaaaagaatgagccttcccttgagcaaatcttgctcagagcccaaacttcaagcccacaaatggacagtcccctgcagcatgggctcttgttcttcaaggggtcaatgaggagacctccctttcccaccccaggtgtctgtagtcagggctgcctgatgttccctgcatcctgggactaggcactcaggtgtgtaataccccagaggacaggcctgggagtaattccaaacacagagctggcctgattcactttcaggttcctttattttaagttaaaatgtcaggatagaaagaagttgggtatggggttattcatgaaactgaggccagaagatgtctttgtgggctgtgagagggtgacatggtggctccaccattgctaggggaatgttgagtgagctcctaagaagtttggggaaatcggtcttgtgagtgtggcttcccttcagctcattccactcagaaacatgaggacacccatgggtggatttttctgaactcacaaacactgacttgtgtcctcttttttcttatcccattggagatattcagtaatctactctgtgagatggggtctacaggagatcatggagaagaaactcttcaacctgtgcaagtgaaacttccttgtgtgaagctcttgatgtgtccagattccaaggtcaccttctcctgcacaggggtcagcagaaacattgaatattaccatggaaactggcccaatggctccagagaaatcctgaatttgtgactgagaactgcagtaatcaaccttcagggatctcagcctgattctcctttttcaacttgactttccttgactgtgcagcccgagggtcaggatgactatcactgtcagagctgaatacaacccgatgctgccatgagctcccattccatggggaagtgacataaacatctgtcctccatttcccccatcaaatccgtcactgccctgtccctgcctgtgaccgacacctgctcaggttgtggattctgctgtcacttgtgattccagcaagtctgatgcttttaacttggtgcatcattattagggaagccactccctctaaatcctcagaagatgcccccaaggagttcccggatcccaaggtgcaggatcaacctcccagtaaggaaggctctctgggccccatcactgttcatctgttctactttaatcctaagaaccttgagccttcattatttcccctttctgcttatttggctggaacgttgctggaatgcatctcagttctttggggactagagggataaaaagcacagcccatagaaagctttcacctggttaagtagcatttcctaagagccacgagggcatctgctcactgctcactgctcatccttgcatcataatgggttcctggaccctgggctctcctggctcattgagtttaccaatccctccacactccactcattgctagggctggctagagggaaggatagtaattgtccaatagggagatagttttaggggggattacagaaactactccccataatctttgttgataacatcttcatcttgatgtttgctccccaggatctgattgtgacagtggaagtctgacacttgaagaaatgtaggtttacccttctgaaaggcctggccctggcttggcctagggctggaaggaagaggtgctgagctttgggcaaccaaggcacagctgtcaaggggctgagctctctgcaatgtgggcctcctgcagagacatccctagggaggctgagacctgacgatgatgcagaaaagcaaattgaagtgagcaggggatggtctgtgggggaatcagatgacaggtggggggccagatgtgatacagatggtgcaacatgaagaaaagtgtcttttgtgattgttctgaggagaagggctcagtgctagagcagtgataatgaggcaggagctgggtcctgaagccacaggggaaccaggtcttgggtctttttctgagggtccctagggaagatcacatgacaaccaagtcccatgttatatgtccagtgctcggtatcccagatgctgtccctcccagagcctctgggtgtcctcgtcccactcttccctgtgatctgttttcagctccaggagcaggttcatactctgtgccaagagtggggcttgcatggctgagtggagaacagatttgcaagaagatcccaccttgcagtctggctctgtgtcctgggtgtgggtggtaactgaggagatgtaggcatttgggctccactagagaccacagggagcagagctcacaggggctccccacaacccgggctcctcccttcatcctcctcccattgccttcctcactggggttcgggccaggggagaacccagggctgcttcaagggccctgctctgcaaccatggtctttatccaagtcattgtctccaaactctgtaagggctttctctgaaactgtaggagcattttttttccatatgcccaaggcaggcttacagggtgctgaccccaccccttaaaagtgctaatagtctctcaatgctcaagacaggagggagaattaggaatcaggagcctacccagagcttccctctttcctcactttcaaaattgcactgtgtctagacatagaatttatgcctgggttgggaaatatttatttacttattaatgtattcattcattaatctcactttctgcaatctgtgtaagtgaggggcagaagggaagaggggcacagagggagaggttgaacccaagggcaggtcctggcagtctgggcacaggctctgatcagccagggggaaggaagagggagcagctcctggtgccctggagggaggggatgccctgtccctgctgggcctcccacttcgttgtacccagggaatgcttttcagagaggcagagctcttagcagagtcccgtaaaccatacagtgagttgggcaggtgagtccaggggtaggggctgtgtggagacctgagaccaggtgtggcctggcatggacactgcccagctccattcttttagggaggacaaagtggacagaggaagagacaggagacatgggtgtgtctgagctttgggcagcaggggatgctgtggcctagccctgagggctgtgctgtggatcccagctgggagccaccccctggtcctggcctggagccctctgtcccctgctcactgggactagcagctgtgtcctcacaggtccctgagtacccacagaatagccacacccaggtccacactctcccggggttagctttccaggcagaggtcaagagtcagaacccaaggtggggtttagacagcccaggagaggaggctggtttgcaagtccctcctaacccccttcgccctgaactgctggaaggataggagagacttgaagaatccaggcccacctgagggtcctcaggacacagctgtgtggcgggtccccaccatggcctgggctcgtggcctctttccttttctccttcactgctcagctggctggggccaggcgtcagggctgaggatgaagggaccaggattgctgtgtgtgtccctgtccactaacctgtgtctcttactctttgtctgtcatgatattcagggtcctgggcctgttctgtgctgactcagccaactgcagtgtccaggtctgtgggacagatgaccccagcacctgcactgggagcagcaccaatgatgggagtatgcacgtgttttggtaccagcagtctccaggctgtggtgcctcagaaaccctcctagtcaacaacaccctgcccagcaggagcgggccatgctctgattgcccatctggggtagtgtcagtggggctcagtgagcagctgagctttcaccccaatatcctcaaccaggcgagcatggcagggctagtttgagctggtttatcctcccatccacctatgcctgattttggcagggcccagtcaggaactgaatttcagcccccatccccagcaatgagttgaatgaaatggtacaaggcagagcacaccagccctcagtattccctccctgaacccagactctggtggttatgggggccagggaggaccagagctttgtctcccacctggcaatgagaatactggttggggatggaagtcagtgtcgttggcacacctgctgtccccctccctgccctggtgtcagtgagtcctctttttctcatgaaagtgtcagcagcactggagtactgagagccagcgttctgcctttgctttggcagtgggaagctgaacctacaaacctgtgtccttcaacaactcaacaagaagatcacctgataaaagggagattagtggtgcctagaggctcaaaatacagtatttaaggtgtctagcattcagttcatgaaatcattgtcacatcaagaattaggacattcagaacccaaatgaaagaagacagtgacacgcatggacactgaagcaaactcagatgctaaaatcatatgacggatttttaaagcaacaaccacaaaatcccttcaatgaataattaaaaacactcttgaaacaaatggaaaagaagaaaatctcagaaaagagaagttataaaatcaaaccaactggaaattaaagaacctaataaactagagcacatttaaaaagaaagttaaggcaggactcaagaactggttacatttgagattcagtcactgggtgaggtgttccacacgacataaaaatacagtaaaaataagtaggtaaacacatgaaaatcaatgattctggtttgacttgggaaacattaaagtggaaaatataaagaataaaatagcatttatttattgaaagaaagaactacctttagctttttatcgtttccccattaatactctcttgaagatgttcccaggggacactgtgagtcttctcagaggtgagaaaagcctgaaataaactcccacgaatctcatttaatgggtcctggggcccatgctcactggtctgagttagaggtgatagcaggtgcttcctctcaagtggtgaaattagacctcacagcagcccagcccccctgacagtagagctgctctctcagctgaaaacaacagaagcagatggtgttggtgatggttttggtaaagtgcttattaatgtgtgaaccaaatatatgcccttcatctagggagctgcataggagataaaagaaccatctcagggtccagcagcatcttagagctctgcagatttttggaaagtttacatcatgccctggatgcttctcctccacttccccatcctgttcagtctttgcccaggttcatggagatttcaaagaccagcccatggagagagccctctgttcttccccattcctgtcgtgtctgtttcggtttcagtatccagttcttagggtgtggtgactgaggagccctcactgactctttcctgaggagggacagtcactctcacctgtggctccagcaccagagtggtcaccaacaatttctatccacactggatgcaacagaagtctggccaactttttgagacattgatttatgatgcaagcaacaaacattcctgaatgaccacctgattctcagaccttcctgggagcaaagctgccctgagcctctgggggacccaatccataggctagactgagtactactcaagctacacgacagtgggggttactgcagtgaaagatccagatggggagccaagacgtaaccctgcctctgacagcctggggagaaaatgatcacgtgatatcaggatcacatgaccagaaacctgagctctcaaggcggtctaaatgttgcctatccttaaagaaaaaggtaaacagaagggtctacatcaatatttattcctgtttgtgtccaaaagttgaggaaatccatcaatgaggaggaactgttccagaaaagcggattcctaatattttgtaatccaaaaggaatagtattgcctacatcagatccaaggaataaatttaaatatatttttttgcaggaggaataatcttcaacgatgtactttgccagctaagaacgaaaggaagaaacgttctttggtatattaataacattttttattaggttgtaattaaggtgtattgcacaatttaaaacatattaaaatgattttttgtaagaaattcttttttctatatgttatgtgttgtattggactctaaagaatatatgttaaagccctacaccccagtattcaagcacataaaatcatttgaaaatcggatcattgaagatataatagttaagatgaggtcattctggagtagggaggtctctttatcagtgttcctgggtccttgtaggaagtcaaccatgagaagacagagaggcacagggagaaagtcatgttaatatggaggcatggagtgaagttactcagctacaatacaaggaacaccaaagattactagcaaagaggaagagctgccaggaagaatcccaggaaggttttctctacaggtgtcagagggaacatggccccgccctatggatttggatttctagcttccagaactgtgaaacaataaatgcctttcattttaaatcacatgtgtagggttatttttatggcagctcaaggaaattattacaccaaacagtcattgtaactatttctgagtttgcatgcattctctcatcttgtttctcagttttttcaacaaatgtgaccatgtctgtcttcgtatttcttccttgtataactggcattgaaggttgacgtaagttattctcgctgtcacaaaaattatataaacatgtaaataaggcttaattttattttgttcgtaggtacaaatgcaaaactaattccaattgttttgtaagaaatttttgtaaatatttttctcatgtaaattagaagggtctcttgagttactgaaacacttctggccatttctgtgatcttgtggtgtcaggatgagatggctaccatgttcaatgaaagcttcaaatacattattattttttctaggtttttaaaatttaatacagtctaattaaatagtaacagcagtaactaaatgcactgaaaaacagacaggtgcctgcctatatctggaataaaattacatcaaactagtctccatggtaaaaaaaaaaaaaaaaaaagacaactgctgatatccatggttagacaagtcaaggacaacttggaatttctaaagccatttttctaaaaatcaacagcaacagggacacaactacttcaaggggtaaaatatctatatctacattgttttttattaacgaagattgagttgcacctaaacagcatggcattcttatctttagccttaaaggaaaagtgaaagtattttccatttgcaccagtttgaaatatttctgaaataaggattacttcaaatgaattattacattacttatacacataagagggtctcacatatagtgaaaaggcaaacccaggattttaacgtcaaccttttaaagttgatttgattgcataaaatgagagagaaattctcacacgcataatctgtttaacaaaactcctcggtgaatcaggatgcaaaatataaaatgttctaagggagactctgatgagcaggcatataaaattgaagtgaaacccatgtcagcttcgttcctcccacttctttggtgcttctatgaggagctctttctctactgcaagagcctggacttttgacctaatggagaagaacctcaggaaggcaaggcattctgataaaatgccccttgagaccttttattttttaatttaaagggatcaactggtcttgttcagccttaggaaagaaagcatcactcagataaaagtatttggggaaactttaaatacctggctacctcttgatatatttaaattagattgacttcagctgttcttagaaagcattctgcatagttatccagagcagccactgaagttctggttctccttacatggctgcattcagaggtactccacatgaggcatgtttagaaaaagaaggacccttatacttgggagtttttgttcttccacgtaacctgttagtactgttggtaaaggcagtccccagatggcaccagtgcattttgtcaatggtgagtctagacagtgttgcaggggtgttgctgatgagtagaacagtgagcagataaaggtgagcagtgttgatctaaaggctttggggtccatctgcttatccttgcacacctgaacaaagtcatcagatgtgccacaccatcaaactgttgaagcttggacttgatacatgatagagttccatgccaattgcccatcttcatattcaacttgcagattagttggtccagctgatattttaacagatactgttagtagatcatctgaatgtgaactatctctaaccaagaaatttccttctggtgtctcttttaacttttctttggcttcattaacaatcatccttccccagtgccatcctgtttgagctcctacggggacttcaccagatgcaccacctccagggaaggttcctgtgctgaccctgctcctcactggctctgcatctattccctgccattcccagagggctggagacaccacagggtcatggaagtaaggtcactgaggcaaagacagatggccacccaaactgggtgagaaaggagctttcatttttcctggaagtcagtgggaacccccccaatcaaccctatgggtttctgaaatggtggaagatggggaaggaatgaaaagctgcctgtttttctcaacaggtccaggttgagggatgacaaagttccttgcagatgcatcacccacagatcaccagcaggaggatcctgaggctgcggtcagtgccctggcacaggacacatgggccatgtcccatgcagcaccggtggctccgagtgagagggcttatgctgcaggggaagccaaagattcctgagccacagcggtaagacatgagatgacttaaatatctgtccctcaagtatattattcttaatatttaatgcacaaaatagtgaaagaagagattagcttgcagtgcaaattgaacagattcagtatagcttgaggcatgagaaacaacagctctattaccatttaccaaaaatacaccctgaatggacagggggtgcccgtgagctggagatagggtgccccaattgaggaaatataaatactggttatcagttaaatttgaattcatgtaaacaaccatttaatagatttttatttttagtataattatgtcctatgcaaagttacttatctttaattctaatgtaactggatgtcttgcatcttgtgagataccattcccagcattcccagctgggctctgacatctgagtctatgctatttacctcaaaaacagagttcctgtaacaaagttatccccaagtaagtacttcggttagaaataaatatgtctgggctgggcacagtggctcatgcctgtaatcccagcactttggtaggccaaggcaggcagattacttgaggtcaggagttcaaaaccagcctggccaacatgatgaaaccctgtctctaccaaaaatacaaaaggtagccgggcgtgggggcacctctgcagtcccagctactggagaggctggggtgggagattcacttgaaccgggaggtggagcttgcagtgagccaagattgcaccactgcacttcagcctgggtgacagggcaagtctctgtctcaataaataaataaataaataaatacataaataatttataaataagtgtgtcatcccatccacctcaaggctgtaaaacctagcatgccttatccctcctcactttcttttttttttttttaattatactttaagttctagggtacatatgcacaacatgcaggtttgttacatatgtatacatgtgccatgttggtgtgctgcacccattaactcatcatttatattaggtgtatctcctaatgctatccctcccccctacccccatcccatgacaggccccagtgtgtgatgttccccttcctgtttccaagtgttctcattgttcaattcccacctatgagtgagaatatgcggtgtttggttttttgtccttgcgatagtttgctcagaatgatggtttccagcttcatccatgtccctgcaaaggacatgaactcatccttttttatggctgcatagtattccgtggtatatatgtgccacattttcttaatccagtctatcattgatggacatttgggttggttccaagtctttgctattgtgaatagtgccgcaataaacacaggtgtgcatgtgtctttatagcagcatgatttataatcctttgggtatatatccaataatgggatggctgggtcaaatggtatttctagttctagatccctgaggaatagccacattgtcttccacaatgcttgaactagtctacagtcccaccaacagtgtaaaactgttcccgtttctccacatcctctccagcacctgttgtttcctgactttttaatgattgccattctaactggtgtgagatggtatctcattgtggttttgatttgcatttctctgacagccagtgatgatgagcattttttcacgtgtctgttggctgcacaaatgtcttcttttgagaagtgtctgttcatatccttcacccactttttgatggggttgtttttttcttgtaaatttgtttgagttctttgtagcttctggatattagccctttgtcagatgagtagattgcaaaaattttctcccattctgtaagttaactgttgtacttagttgtactgggtttgatcgtagtttcttttgctgtgcagaagctctttagtttaattagatcccatttgtcaattttggcttttgttgccattgcttttggtgttttagacatgaagtccttgcccatacctatgtcctgaatggtattgcctaggttttcttctagagtttttatggttttaggtctaacatttaagtctttaatccatcttgaattgatttttgtataaggtgtaaggaagggatccagtttcagctttgtacatatggctagccagttttcccagcaccatttattaaatagggaatcctttccccatttcttgtttttgtcaggtttatcaaagatcagatggttgtagatgtgcggtggtatttctgagggctctgttctgttccattggtctatatctctgttttggtattagtactatgctgttttggttactgtagccttgtagtgtagtttgaagtcaggtagcatgatgcctccagctttgttcttttggcttaggattgtcttggcaatgcgggctcttttttggttccatctgaactttaaagtagttttttccaattctgtgaagaaagccattggtagcttgattgggatggcattgaatctataaattaccttggggagtatggccattttcacgatattggttcttcctatccatgagcatggaatgttcttccatttgtttgtgtcctcttttattttgttgagcagtggcttgtagttctccttgaagaggtccttcacatcccttgtaagttggattcctaggtattttattctctttgaagcaattgtgaatgggagttcactcatgatttggctctctgtttgtctgttattggtgtatgagaatgcttgtgatttttgcacattgattttgtatcctgagactttgctgaagttgcttatcaccttgagattttaggctgagaggatggggttttttattttattttattttattttattttattattattatactttaagttttagggtacatgtgcacaatgtgcaggttagttacatatgtatacatgtgacatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgcgatattttactgagaatgatgatttccaatttcatccgtgtccctacaaaggacgtgaactcatcattttttatggctgcatagtattccatggtgtatatgtgccacgttttcttaatgcagtctatcattgttggacatttgggttggtttcaagtctttgatattgtgaatagtgccacaataaacataggtgtgcatgtgtctttatagaagcatgatttatagtcctttgggtatatacccagtaatgggatggctgggtcaaatggtatttctagttctagatccctgaggaatcaccacactgacttccacaatggttgaactagtttacagtcgagacgatggggttttctagatatacaatcatgtcatctgcaaagagggacaatttgacttcctcttttcctaattgaatactctttatttctttctcctgcctgattgccctggccagaacttcgaacactttgttgagtaggagtggtgagagagggcatccctgtcttgtgccagttttgaaagggaatgcttccagtttttgcccattcagtatgatattggctgtgggtttgtcataaatagctcttattattttgagatacatcccatcaatacctaatttattgagagtttttagcatgaagggctgttgaattttgtcaaaggccttttctgcgtctattgagataaccatgtggtttttgtttttagttctgtttatatgctggattatgtttattgatttgcgtatgttgaaccagtcttgcatcccagagatgaagcccacttgatcatggtggataagtttttgatgccctcctcactttcaaacagtacaacagttaacatttcctaaccattggagatattaaagcacagatcttttatatgagattagttaaaatttttatctttaatgcacaagagtttgggaacattaggaatttgtacatatgctaaattatatgtaaatgaaatgatacgatgtttggaatatgttttaaaattagttgagtgtgtggagtgaggggtaaagagggatgtaagatgaataagacaattttatgttgatgatgatttagttgggatgctgggtccaggacatgcaatgggcttttctccatagatgtctgcaacttcaaaaacatccacagtgacaaatgtgtaaaaaaaattctgtgaactcttctgtggtggtgtgtgtattgaggtggataagggaccccctattaagggcctgacttctccccctgaagcacggaaataaaggagaatcttgagtttcttcaagggaaatttcaggtacctcactgtccctgagaagaaaacctgactagcaaaaaggttaaaggagcttaaaacaaccaaggaagttagaggcatgggatgtctgggtccctatagaaactaaaaacaacaacttaacatatgcccctgagttgtttttcaaacactcagaccacctccaaaagtctcggctgtcagtaggcctcagataatgggaaactgaggactgaggtctgactgcccttctttgttctaagtctcttactgaggggccctgaggaaatcacgcccatgagccagagctaacatttctttctgttgaccccaattttttggacaaagctttacgaccttaaccagttgcaaatcaggaaatttctaaatctacttacctttgatctgaaagcccctgcttcaaaatactctactgttttaggccaaatcagtgtataacctctatatattgatttacagttttgactatgacttctgttttctgaagatttcccctgcttttaaacacctttgctttcaggccatcagggagtttgggtcttaagcatgagctgcccgattctccttgcttgatgcctgtgataaatgtctcattctcttgctgcaatcctgatgtcagtgcttagatttgtatacctggtcaatggattcaagtttggtccattaatagtgtgtcttgcttttaacagacactcagagttgccagatggtgtgcctccaccctgacctccagttgaagctcatctcctccccgcacacagaggaggacttggtgagaaggccacagaatggaaaggagctcagggtttcccaggaaagagaagtgagtgatactggaggccccagagcaagaggaagggctgtgaggtaggcaggggccataaagtgaagggcatgctggtggggctgcaaggtccagggtttatgtaaacagcaatgaagaaccacaaaaggagtttaagcccaggagtaagatgaacaggctgaatgagaaggatgtctccagctgcctcgaggagaaaggcctgagggcaccaggggatcctggtcatagattattcactaagagaacctgtgagtctagaagtttgaagactatttgcacagttaaagcagatttgcatctgggatacagtgaagaagtgataatttctgcattaatctgtccagtcattcaacgtttctgcagaaacattaaaaggtcacacttatctttcttagtaagccatgaaaaaaatgtaagtagggaaaattaggtttagaatataaacaaattgtattctatctaaaacaaaattctattgagaagtagatgaaacagataagcagaaaaataaaaaggtaggaagacaaaactcacttcataaaataagaaatgtgttacaccatgaactggtaaatgttatgcctacccaactattattttttcacaaataaaatctagtgagtatcaacatgctaaaatcatggtgtgacttaggaaatgttttctgggccaggtgcggtggctcacgcctgtaatcccagcactttgggaggctgagatgcgcggatcacgaggtcaggagatcgagaccatcctggctaacatgatgaaaccccgtctctactaaaaatacaaaaaaaaaaaaaaaaaaattagccaggcgtggtggcaggtgcctgtagtcccagctactcaggaggctgaggcaggagaatggcatgaacctgggaggcggagcttgcagtgagctgagatcgcaccattgcactctagcttgggcgactgagtgagactccgtctcaaaaaaaaaaaaaaaggaaatgttttctgaattgctggatgttaaatctatcactgaggtgattcctgaaacagtccccttctatgtcattgccttgaacaaccccttcatgccactcaagtcagcacaactgtttcagcatctgtggtggtgccatagtgacgtatgcaggtcacttagctttttctagaatgtactcttggggcactggcaccttaaaaggttataaaatttttaaacagttataaacgaacatatttgctcctctcatagatcaagactacttataggagtgagatactggctaggcatctagtagaccacgtcatcatcacaggatataggattcaggacacagatgtgtatacagaggaatagtgtcctggtgagctgcagagatcagctgggctctctggtctctgagccatggggaggtgagtgtcctgctatcagcaggctgcactgtgggacttgcctgtggtgtctgcacagctgctctttaagaaccattcattccaaggagcctaggtctaggggctgggccttgtgctcattgatggggactcggcagctgtcttctctggtctggcagagtctgctgaacagggacctgtgtatggtctcagcaggtgatatctcctagggcccttccaaggagggaaagcaaatcatcttcctcagtctgcagtgtgagctgggctccagccccagggctcaggaagggactgggcagtccctgcatagaaacacatttgcatgagcagcccctcctctgctgggggttgggaagaaaaggaggcctggggcagctcaggctcactgtggtggtcaggggctgtgtccaccatggccagaacttctctcctcctcctgatcctctttcactgctggcctgaacttctcttctccttatgctcctctctcactgcacaggtaaggacaggcctcggagatcaggactcagttttcagcctgcatcagtccctcaggctcaggaacccatgacaaatttcatcctcatcttaaccctgtctcttatttgtgtctgtgtttacaaattccctctcccagcttgtgctgactcagctgtgtcctcccccctacttcctgtatctctgggagcatcttccagactcacctgcaccctgagcagtggctgcagtgttgacatttatctcatatcccgctgtcagcaaaagccagtgagcccttcccagtatctcctgatctacctctcaaaagtcaagtaaaactagggctctggagtctccagctgcttctctaaatccaaagatgccttggccagtgcaggcaatttgctcatctctggggtccagccagaggacaagactatctgttctatctattactgtcagacctgggatattgatacttcagttacacaggcagatgagaaagtgagacgaaactcagcctactaagaatggaactatggctctttttccaattgtcaaataattttcacatacacaaactattttggaagtagctactgattcacaatggttctctcaatgtcccattcaatgtttctgagtcctcaggcaaactaacaacaaaacaatgataaaacatatgacaaaacatatgataacactgactctttccctgctgaaccacatgtaataaaaccagaggagctggtttaataaaacctgaggagctgacttttcttttaaaagaaaagatgacagtcttttggagtctttttcttggtcaaaatttcctagaccatcccagcaggtggacagtcccctacagaagacacgatcctgggaggaatcccaggtacagagctggcctgcttcacttgtgggtacctgccccttcaattgtgaaatcagggaggggagagtaagcatagggggtaggtgaggatcaggaaaggggcaaggccactacatttcattaaccacctttggactccagtgcaagatagaggctgatgatcccatcacacaggtgactacaacctccttgtcatcaacagctcctgcccatggggaagcgaaatgaaaatctatccccatccctctcttcttacatatccctgtcctgcccctgccggtgaccaacaccagctcaggttgaattttgttttgtcacttgtgctattaaagaaaataactccttctcttactggtctcctagttcagacagaatcagtttgtttccagaaatagaaaacgctgctcacacacatgagtgtaaagtaaggatgacaaaaagaaaaaatccaggctatgtggcccagagacccaggtgccctctgattggcctcatagatgtcccctcctcctggcccaggtttgcttgtcattccttaagctctggaaccttgaactacatgggttctgtcttcatagatacagaagaaaaccctccccaagaaggagatggttcccagaaccagcacatgctcacttttctctgtttaattccacacatctgacttatttttgcttccatgagcctttgttgaagatatctctgaatacctctcatttctgttaggtctacagcctatggacctatctccattatatttgtgcttatttttctaacctttatgactgattatcatttaagcttaatatgagatatgcatctatattaaagatatataaatatgtcatcaatggtcaatattattaaagttataagtagtaatgcaaaattgtagctattatatcatttcacttgttcactaacattaatatgtgaagtgagaagatcactttattaatcacgcactcctggtcatgtgtgcggatgagtaagctcaggggggatgctgccatggtccatgggaagcctcaagaacagcagacctggcacatcaggcacaacatgggacacagggagtgagccatgtcagcagaaagcagaatagactgaggcatcagaaacaacccattgccaaactctccactgccttcctgcatgggtcagaccagagctgctcaaacataacgtgcacacagatcatctgggctcctggaaaatgtggactcaggggtctaggatgaggactgagattctacacttctaaagatcccttctcctacaaatccacatatgtgtttctgtatcacaaaattagtaagaatgggggaaaataagaaggaaagccatttgtagacaggaagcaaagaaacatctttcgcggagagaactacagaattttcatgaagaaagacttccagttgaggcaggcagacaaccagagaggacagccgagaagactgaggaggctcctctttcttcacaaaacaaacaaatgaaagcaaaaagacaccaagcctcccccttacctgccctgccctctggctcctgtccaatctccccaccagcttctccttcagcctcttctaaattgtggaccctcctcaccttcccttcaggagatgccctgagtccactgcttctctttcccaaccccactagcaccttccgctacttcctgggtttctcctcagctaccagagaatgcagtgaaccatccaatccaaataaattatcctgttaaacattgaccagtaggtctcctttgtgcggatctgaggaatcaagcagggagaaagaacctgactttgtgagctgcctgagaaatgagttcatggctgaagtgtcccttttctcagctaacatgttttatttcatgcacagggtgtatacagagacaatcttcccctgaggactccataaaagatggggagaattgtgtgtccagttcccattgaggagacacacacagaaaactaaaggctgaggtgaggtaggaggctgccctgaggacgggccttgccctgcccttggtcagggagtgagcagtgttcaagaccctggtggggacaggaggctctgtcaggaccccggcatctggtcagagacacggtggacctggacttgagcagcaggggatgctgtggccctgctgctgagccctctgtggggctgtcagctgggaaaccagaaccctgtgtggtctgtgctcagagatcactgggccaagtagctggatcctctgtgggctcctggggagcctcaggccaggctggatcctctgtgggctcctggggagcctcaggccaggcccaagttaggcccacccctcccagaaatgacacagccattgccgctgcatacagccccagggaggggtacggttgggcagaagagagacaagtttgcatgaagggcccctctctctcttctgggactaccggatggataagagggacctgcatcatgtcagcctcagcagagctctggggtgtttgcaccatggcctggaccccactcttcctcctcctcaccctcctcctccaccactgcagaggtcaggatggcccttagcaccctgatcctgcagctcactcacactgcctcacaaactcataccaggaatgtccttccctcttatccttacttcaggccataatgggcgtctatgtcttcagggtccctctcccagcctgtgctgactcagtcacccactgcatctgcctccctgtgggagcctcggtcaagcttacctccactctgagcagcaaatacagcacctacattattgagtggcatcagcagtagccagggaaggtcccttggtacttgatgtatgttaccagtgatggaagccacaaaaatgggatccccagttacagttctcaggatccagctatggggctgatcggtaggtcaccatctccaacatccagtttgaggatgaagctgattgtatctgtggtgcagatcatagcattggtgtgacatatgggtaaggcaaagtgaccccagtgaatgaggaagcaggacaaaaactgttttctctgctccactatgaaggctgccacgtggccctgagaaacagtgcctgttttccttactactcaagaaagatagatagatagataggcagatagctagctagatagatagctagctagacagataggcagatagctagctagctagctagctagacagatagataggcagatagctagctagatgctagatagacagatacctagatagctagatagattttttgctttgggttccttaggaacaagtttgctaggccaagctcctaaggagtacacaagtctgtattaatgtggccaatattaaggcagatcctgtcaccccctgcatgtcgatacattgtcaccacatgggaactgcaaggacatttttccctgtggatttaaacactggaactctgctgcatggcacacccctgccacatcaagtttcattttaacaatcacccataagatataacttcttaagaaaattttgaattctaacaaaatgctagaaatcacactgttgatacacagcgatggaaataatgaaaatttatagacagtgaaataaaaagatttaaaatttttggtggtttataaaggttttctcagttgttcagtgcgtgggttttgggattaggagaaaatgaggagaaactgcctccaccacattgaacatgacaactgatttgcaataatctaacaaagaagaaggatataaataatcattaatgtcatcctgacagccctgatcctaaatgtcagaattttatttcttaacttttttctccaaaaaaaaaatgtagcttcagaaaaacttctggaatggtggtatgaggccatcagaaaacctgattcaccatacaagcaatgagaacagcagtaaaaatgatataaatctacttttcagaactctgtacattaccaaaagcttacaaaattctgggaatcataaaaaatagtaataacagccagacatggtggctcatgcctataatcccaacacattgggagctgaagcagagcgattgctttatcactcctgggattttgtgatcagactgggcaacagagtgaggcctcttctctaaaaaacattttaaaaaagtagctatatgtggtggtgtgtgggtgtagttgcagctactggggaggctgaaggtggaggatcacttgagtctgggaggtggaggctgcagtgggctgtgattgtgccactctacttcagcctgagtcataaagcaataccctgtctgaatcaatcaatcaatcaattaaaataatgtggaatctctgtaagaatctgaagctttgtggtgattttatttcttttgctctctcccaagttccacagtagccttaaaaaccaacagcctcaaatctcctggatctagggaaactagaaaaatagcattcactgaagcaaccaaataccagatctggaattttctcaaaagccccattcccgtgcgactgtcattatttgagctttccaaagctcagaaaagcttcacgctctgtacttttctaaatgtgaattgtctcagagctcgcttggtttaaacagcttcatcctcaatacatttatcaaaacaatcagtgagatctgttaaggtcctgagtcagtgatacaagatggggtcaataaaaggctgaccaaaaaccttgagagaaaaaaactgggtgtcagaatctgtagaagattttgatgagctctgccatattcctggaaagacagaagatcactctcatgctcagagttatgtgcatggccaggtaaaaattaggaaagtccttaattttcgacactggctgaaatcaacaaggaaggctaaaatagagttgtaaagtggcggggttttgcagtcatgacccaacccctgcacagagcattcggcaaatgctgaggaatgtgttgttcgaggcgtttaagaacatgtctgtccaataataagctaatgactgatataattgagcagagactgcagtggctgcacaagcaaagaaaacagacttagagaattattccagtaccgtgaaacaataaatcatcatcaacaataacaactacaacaaaaccagaagcaattatgacaaatattttaaggaaagaatctgatttccagaatcgtcacattgtgtgactgagaagctccatttggcaaagtgaaattttgaggcagggacacagcaaagtactgtccatacacagggttaaaaaggaaagcaaagcaaaacataaaaacaaacaaacaacattaaaaataagttgacaaaatgatgtccagagatgcatttggtggttactacataaaaacttcaaattagcttttgtaaatgtggtcaaataaataaataaaacaacgttaacaattgttaaggaaagtacggaaagaatgcctcattacagagagaacattggcggggtgcagtgcctcacacctgcaatcacagaactttgtgaggccaaggcagacagatctcttgagcccaggagtttgaggctagcctgggtaacatggccaaaccatgtctctacaggaaatacaaaaaagctagctgggcatggtggtgcatgccagtagtaccagctactcaggaggctgaggtgggaggatttctggagcttgggaggcagaagttgcaagagcaaagatcatgtcaatgcactccatcctgggggacagagcaagagtctgtctctaataataatataataataataacaatagagaatactaataaagaggtatagaagaaaggatcattgaattaaagacagataaattgataattattctgttccaagaatagaaaaaaatgacaaacagtctgcacaacctgagagacgatgtgacaccaatcaaatgttccaatacacacatagtaagtttcagtccttccaccatgtgagctcgcagtgagaagatggcagtctatgaaccagtaagcacatccttaccaaacaccgaagtatctgcttgtactttgattttggaccttccagcttccagaactaaactctgacctattttttttggacatttgcatagtgtgggcctcagaaggaagctggctggaatttgacatcacagccactagtagtctgtgggttgtaaccccacagcataacatggggcttcagctgagcgtagtgacagaggatggagtccacatccaccctctagctgcagacctggtgggcagagacagcacttaggctatgcagcccttcatggtggctttcttcaaagtcattgtggtccatgtgtgcatcaccaggtcagcctctggctggcgttgacagcagagttgtactcactttacccagtcccactacgtggctcaagtctccagtacttcagattacatcagcagcaaattaaaaacagcctgcaggaagcatgagctatatgtgagcttccaagacctggatggcaggactggttcatcgcacccaagggctatgctgctaattactgtgatgtagaatgctccttcccaatcaatggacatgtgaatgcaatcaaccatgtgatcattcagaccttggttcaccttatagatcctgaatatgtcccaaagctgtgctgtgtgccaactaaactcaatgccattttggttctttacttcaatgacaattccaaaatcaccttgaaaaaaatacagaaatatggttgtaagagcttgtggatattgctaacttgaaaccagatgctggggacacacattctgccttggattccttggtcatagctgccttaaaaaacatacagaagcacagtggaggtggagggataagactttgaaaccatctcatgctgatgccttactgcccgagaaaaattttaacggaccttgctaataatttgctcacttggtaagtaacatgagtagttgttggtctgtactaagctgagtttggttgtctggtaactacagaaacttaaacttaaaaggtaccccccaagcccaccaaatttaattttagctatagttcaagctatttgggttattagtgagtaaatagggaaaataatctcaatggagttaaatgtattcttgggtaaagtatcagctggtttattagtgtctatcaaaggtacattttacagatagtgaaagttggggaagtaggaataactcctctattcacagatttcattcccaggaaggcaaattttatactggatccacagtccaggccatagcccgggctccttggggatgcctctgtctcagtctttgctgttatgagtttgtgctggagttctgttggtgtgaaaatatacttatttcagtcaaaacaaaccatatcattttcacatctcagtcctccatttgctgtattctttgctagtacccaaagtagactgattaaactttgaagtgaggcttagaggagtggaaagcatttgtgacaggctccatggtaactgtgtaacatgtgaaagcaatgctgcacctcttctttattggaatgactttttgaccagcacattaacttgaggactgccgactctaatatctatttcaggaaagcggtgctttgtctttttactacagagcataccacgtgattgggttagaaccaacaaaggaaataaaatgggaaagggtgccccacctttaagaatggctttagggggatgagtgtgccatttatgaatggaaattatgattttctcttgtagaaaggaaggctcagattaaattttagaatatttttaaaatatctttttcaccaacatgtactgggaaagcaatttcatactaaactgattaaatgatagttttataatctataactgcagtaatggttttttgtaaatatgaagtataatttattttatatctgttttgctgtaacattgaaggaaataccagacattttctttaagtgtttatttagaaagtaccaggagatggttccaagatggccaaataggaacagctccagtctacagctcccagcgtgagtgacgcagaagatgggtgatttctgcatttccaactgaggtaccgggttcatctcactggggcttgttggacagtgggtgcaggacagtgggtgcagtgcactgagtgtgagccgaagcaggatgaggcatcgcctcacctgggaagtgcaaggggtcagggaattccctttcctagccaagggaagtggtgacagatggcacctggaaaatcgggtcactctcaccctaatactgcgcttttccaatggtcttagcaaacggcacaccaggagtttatatcccgcacctggctcagagggtcccacgcctacggagcctcactcattgctagcacagcagtctgagatcaaactacaaggtggcagtgaggctgggggaggggcgcccaccattgctgaggcttgagtaggtaaacagagtggccaggaagctcgaactgggtggagcccaccacagctcgagaaggcctgcctgcctctgtagactccacctctgggggcagggcatagccaaacaaaaggcagcagaaacctctgcagacttaaatgtccctgtctgacagctttgaggagagtagtgattctcccagcatgtagcttgagatctgagaatggacagactgcctcaagtgggtccctgacccatgagtagcctaactgggaggcaccccccagtaggggcagactgacacctcacatggccagatacccctctgagatgaaacttccagaggaatgatcagacagcaacatttgctgttcagcaatattcgctgttctgcagcctccgctgctgatgcccaggcaaacagggtctggagtggacctctggcaaactccaacagacctgcagctgaaggtcctgactgttagaaggaaaactaacaaacagaaaggacatccacaccaaaaacccatctgtatgtcaccatcttcaaagaccaaaggtagataaaaccacaaagatggggaaaaaacagggcagaaaaactgaaaattctaaaaatcagagtgcctctcctcctccaaaggaatgcagctcctcaccagcaatggaactaagctggacagaggatgactttgaggagttgagagaagaaggcttcagacaatcaaacttctccgagctaaaggaggaagtttgaacccatcacaaagaagttaaaaaatcttgaaaaaatattagacaaatggctaactagaataaccaatgtagagaagtccttaaaggatctgaaggagctgaaaaccatggcacgagaactacgtgacgaatgcacaagcttctgtagccgatttgatcagctggagaaagggtatcagtgattgaagatcaaatgaatgaaatgaagagagaagagaagtttagagaaaaaagaataaaaagaaatgaacaaagcctccaagaagtatgggactatgtgaaaagagcaaatctacatctgattggtgtacctgaaagtgatggggagaatggaaccaagttggaaaacactctgcatgatattatccaggagaacttccccaacctagcaaggcaggccaacattcaaattcaggaaatacagagaatgccacaaagatactcctcgagaagagcaactccaagacacataattttcaaattcaccagagttgaaatgaaggaaaaaatgttaagggcagccagagagcaaggtcaggttacccacaaaggggagcccatcagactaacagctgatctctcggcagaaactctgcaagccagaagagagtgggggccaaaattcaatattcttaaagaaaagaattttcaacccagaatttcatatccagccaaactaagcttcataagtgaaggagaaataaaatcctttacagacaaacaaatgctgagagattttgtaaccaccaggcctgccctagaagagctcctgaaggaagcactaaacatggaaaggaacaaccggtaccagccactgcaaaaacatgccaaattgtaaagaccatcgaggctaggaagaaactacatcaactaacgagcaaaataacaagctaacatcatgacaggatcaaattcacacataagaatattaaccttaaatgtaaatgggctaaattctccaattaaaagacacagactggcaaattggataaagagtcaagacccatcagtgtgctatattcaggaaacccatctcacgtgcagagacatacataggctcaaaataaagggatggaggaagatctaccaagcaaatggaaagcaaaaaaaggcaggggttgcaatcctagtctttgataaaacagtctttaaaccaacaaagatcaaaagagacaaggctgttacataatggtaaagggagcaattcaacaagaagagctaactatcctaaatatatatgcacccaatacagaagcacccagattcataaagcaagtcatgagtgacctacaaagagacttagactcccacacaataataatggaaggctttaacaccccactgtcgacattagacagatcaacaagacagaaagttaacaaggatatccaggaattgaactcagctctgcaccaagcagacctaatagacatctacagaactctccaacctaaatcaacagaatatacattatcagcaccacatcacacttattctcaaattgaccacatagttggaagtagagcactcctcagcaaatgtaaaagaacagaaattataacaaactatctctcagaccacagtgcaatcaaactagaactcaggattaagaaactcactcaaaactgctcaactacatggaaactgaacaacctgctcctgaatgactactgggtacataaagaaatgaaggtagaaataaagatgttctttgaaaccaatgagaacaaagacacaacataccaaaatctctgggacacatttaaagcagtgtgtagagggaaatttatagcgctaaatgcccacaagagaaagcaggaaagatctaaaattaatacccttacatcacaattaaaagaactagagaagcaagagcaaacacattcaaaagctagcagaaggcaagaaatgactaagatcagagcagaactgaaggagatagagacataaaaaacccttcgaaaaatcaatgaatccatgagccagttttttgaaatgatcaacaaaattgatagactgctagcaagactaataaagaagacaagagagaagaatcaaatagacacaataaaaaatgataaaggggagatcaccactgatcccacagaaatacagactaccgtcagagaatactataaacacctctatgcaaataaactagaaaatctggaagaaatggataaattcctcgacacatacaccctcccaagactaaaccaggaagaagttgaatctctgaatagaccaataacaggatctgaaattgagacaacaattaatagcttaccaaccaaaaaaagtccaggaccagatggattcacagccgaattctaccagaggtagaaggaggagctggtaccattccttctgaaactattccaatcaatagaaaaagagggaatcctctctaactcattttatgaggccagcatcatccttataccaaagcctggcagagacacaacataaaaagagaattttagaccaatatccctgatgaacatctatgcaaaaatcctcaataaaatactagcaaactgaatccagcagcacatcaaaaagcttatccaccatgatcaagtgggcttcatccctgggatgcaaggctggttcaacatatgcaaatcaataaacgtaatccagcatataaacagaaccaaagacaaaaaccacatgattatctcaatagatacagaaaaggcctttgacaaaattcaacagtccttcatgctaaaaactctcaataaattaggtattgatgagacgtatctcaaaataataagagctatttatgacaaacccacagccaaagtatcatactgaataggcaaaaactggaagcattccctttgaaaactggcacaagacagggatgccctctctcaccactcctgttcaacatagtgttggaagttctggccagggcaatcaggcaggagaaagaaataaagagtattcaattaggaaaagaagaagtcaaattgtccctgtttgcagatgacatgattgtatatttagaaaaccccattatctcagcccaaaatctccttaaggtgataaacaacttcagcaaagtctcaggatacaaaatcaacgtgcaaaaatcacaagcattcctatacaccaataacagacaaacagagagccaaatcatgagtgaactcccattcacaattgcttcaaagagaataaaatacctaggaatccaacttacaagggatgtgaaggacctcttcaaggagaactacaaaccactgctcaacaaaataaaagaggatacaaacaaatgggagaacattccatgctcatggataggaagaatcaataccgtgaaaatggccatactccccaaggcaatttatagattcaatgccatcccaatcaagctaccaatgactttcttcacagaattggaaaaaactgctttaaagttcatatggaaccaaaaaagagcctgcattgccaagtcaatcctaagccaaaagaacaaagctagaggcatcatgctacctgacttcaaattatactacaaggctatagtaaccaaaacagcatggtactggtaccaaaacagagatataaaccagtggaacagaacagagccctcagaaataataccatgcatctacaactatctgatctttgacaaacctgacaaaaacaagaaatggggaaaggattccatatttaacaaatggtgctgggaaaactggctagccacatgtagaaagctgaaactggatcccttctttacaccttatacaaaaattaattcaagatgggttaaagacttaaacgttagacctaaaaccataaaaactctagaagaaaacctaggcaataccgttcaggacataggcatgggcaaggacttcatgtctaaaacaccaaaagcaatggcaaccaaagccaaaattgacaaatgggatctaattaaactaaagagcttctgcacagcaaaagaaactaccatcagagagaacaggcaacctacagaatgggagaaaatgtttgcaatctactcatctgacaaagggctaatatccagaatctacaaagaactcaaacaaatttacaagaaaaaaacaaccccatcaacaagtgggcgaaggatatgaacagacacttctcaaaagaagacatttgtgcagccaacagacacgtgaaaaaatgctcatcatcactggccgtcagagaaatgcaaatcaaaaccacaatgagataccatcccacaccagttagaatggcgatcattaaaaagtcaggaaacaacaggtgctggagaggatgtggagaaataggaacactgttacactgttggtgggactgtaaactagttcaagcattgtggaagacagtgtggcaattcctcagggatctagaactagaaataccatttgacccagccatcccattactgggtatacacccaaaggattataaatcatgcttctataaagacacatgcacacttatgtttattgcggcactattcacaatagcaaagacttggaaccaacccaaatgtccatcaatgatagactggattaagaaaatgtggcacatatataccacggaatactatgcagccataaaaaaggatgagttcatgtcctttgcagggacatggatgaagctggaaaccatcattctgagcaaactatcgcaaggacagaaaaccaaacaccacatgttatcactcataggtgggaattgaacaatgagaacacttggacacagggtggggaacatcacacactagggcctgtcgtggggtgggggtaggggggagggatagcattaggagatatatctaatgtaaatgacgagttaatgggtgcagcacaccaacatggcacatgtatacgtatgtaacaaacctgcacattgtgcacatgtaccccggaacttaaagtataataataataataaaaagagtcagccccctagcctggcagtgctgctctacaggcaccctcagccctgatcccttcactgcacctaggggacacagtttacaggactgagtcagtgggacaccctgttcctttacattcccagtcatgggctcagattctgcacttgtctcactgctggagggaggagcctgcatcagtcaccctcaaagaagacatgaagttatttcacctgtaaaggcaagaaactgttcgcagcactgggggcaggcttggggaagatgaggtttgtgaggatgttgagaattcatgcagctcatccttcagccctatagctttccagagaagtgtataatgggggtcactaggcatgtgagtaactgatttggtgaaagatgccacttcagatcaaaagtgcatttccccttccccaaggtgtcagcaacactgaaacatatttgactaactttatagaggaagattaagatagaggatgagagagacataaggcctcaggaatatcttagccaatagaaagcctgctggaagatgcatttccaatatgattagactgattgaaaaccttgaaactaaacacttccaaaggagactgggacccatttctcctgagaatgacaacacaaaaaatagtagaggaaaccaacaaaccaaaagcagacactgtttcagatctattgaaaatcctcaagatagtctcataatataatattcaaaatatctaggatacaattcaaagaaacacttgttatatcaagaagtagaaaaattcaccatttgaatgagaaaaggcaatccagacatcaacgctgagatgatttagggctgaaattacctgacagatatattgaaatcagccaccataaaatcctgttgatgagcaatttcaggcattcttgaaacaaatgaaaaaggataaattctcagaaaaaatagaagtcataaaatcaaactaaatataaatacaaataaaataaatgaaaaatttaaaaatacctctctggagagactcaagaacaagtaactatgaaactaaaatccacgcattagagaagacacttaacactgttaactagagaagcacaaaccatagttatcacagcccagcagggcgagcaatcagtctgctcagaagtgagaggcctgaaaaaaaactcctggtgtccctgatggtgaaatctggcccctgatcccagggttcctccctcttcgtgctcagagggctagacctagcagtgaagggttcccaacctcaccctatgcggcccctccagaaggcagagcccattcttgctgatattcccgatctccaataacacaaagtgaaagagaatgtcttaaccagagtactgagtcttggcctatctgaacatatttcaaagtttaaatgtacagtgagcataggatgctgagcagaggccccctggacagtggctggagttgggagcagtgcaggatggaaggacaggtcaggggccctgagcacctgtacctgcacctgcacctgcccagggtggacatgactcccgcatccaccagagggcgttgtggtctaagcaactaatcagagctccccagatcctctgctgttttccctccacctgctggtgtttctgtgccctccagatggtgttgctcctcccccttctatgaccacttttcagccataaccttgtctgaggtcaaaggagggggttgtgcaaccttcagaaagggagaaatttgcatggagccctaccactctgaggatacgcgtgacagataagaagggctggtgggatcagtcctggtggtagctcaggaagcagagcctggagcatctccactatggcctgggctccactacttctcaccctcctcgctcactgcacaggtggctgcctgcaaggaattcagggagcgttcctggatgtcacctgggctgatgatctgttcctcctgcctgggaaccagtcttcatctctcccgactgatctctgtgttgctctcttcttgcaggttcttgggccaattttatgctgactcagccccactctgtgtcggagtctccggggaagacggtaaccatctcctgcacccgcagcagtggcagcattgccagcaactatgtgcagtggtaccagcagcgcccgggcagttcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatcacacagtgctccagacccatggggaagtgagacagaaactccccagagcatctctacctgggccagtctcagcctgtctccaccagagagggtagctctcccatctctcctgtctaagtgcttgaggtgaactttgcttatgacttcctcttttccttttcaaaataccaatctgtttttccacaccttgatggctgattttctgatatgtgcacgatcaattgtgggataaatgtagtttataatcgggtctctgagccacaccatgattgatgttctggttggggctgccttgcacagtataagttattgacttgcatctctggcctctacccttagatactattaacaccctcccctcatttgtgacaacaagactgtcttgagacactgccacatgtcccatgcttggggacaaaatcagcccaggttgagatactcagttaaagagcatgtcttcagctactaagaagcttggctttgaaatgtgtttatgccattctgctgagcatgaggctggttttctaatttttgtttctggttcccatctatgagacaaaacaataacaccaaacttcaatgttttgatggttgaatggtttttccaagcaacaagaagtcagagattgtgctacttagaggtgtagaagccctaaccagatcctgtaacacagagtttagctctgactaggacagcacacaatgccttccatcaatctccaacccacagcccgcaggctgcatgcagcccagaaaggctttgaatgtggcccaacacaaatttgtaaactttcataaaacattatgatttttctgcaattttctatagctcaccagctattgatactaacagttagtatcagttttatgtgtgttccgagacaattcttcttccattgtggcccagggaaatcaaaagatgggacacccctgctttgcacttttgtacaatgcacatggaaatataatagagccttcttccttctaaggtcatgtgactcagccattgaaaggtggaagtgctgaaatgagctccatatgaacggaccttgaaaaattatgctcagtgaaaggaacaaatgcaaatatctagaaatgaaatgtctggaaatgactgtatttataacaaatgtccatgatacgtaaattcatggaggctgaaaagatcgagattatcctcaaaccttgtgataatttaggtgaaaaggatgatttcagaattggatagaaagtgatctacttcaaaaataagctggaaatgcctccacgaacagaggcgatgctttgcggaatcctaggtggagaagtgtatcaggtgcagatgaggtctttaagaatacttcttgttttgttttgtaaaattaaatatgaataagaacactgtgggccaggcgcggtggctcacgcctgtaatcccagcactttgggaggctgaggccggtggatcacgagatcaggagatcgagaccatcctggctaacacagtgaaaccctgtctctactaaaaatacaaaaaaattatccaggcgtggtggcaggcacctgtagtcccagctactcgggaggctgaggcaggagaatggcgtgaaccagggaggcggagcttgcagtgagctgagtttgcgccactgcactccagagcctggctgacagagcgagactccatctcaaaaaacaaaacaaaacaaaaaaacactgtgcttgctcgcttacctcctcctcaggtcatttcctgcagtctctaagaacagtccgcctggcttccccatctcctccctgagcgccagcatctggggcgtgaacagcacaatcaaggccacacctgtgagaccctcagtgcgtcagcagagctgtgtcctggtgatgtcaagggacacggggtcagcaggggacctgtgaggctgtctcagggggtgagcatgtctggccctgccagctgggaaggccctcaggaggttgaggggagctgagcacacagtgagctcactgagctgagatgggaagtgactgcagctgtcaggaccttcagggacactcagtctaggatcaggctctctcaccctgtggggcctggttcaggtcaactcctcatcctcctcttcttcctccagacaagagagacattgcctatggctgaggggtcctggaggtgatccgggtgcagggacttatttgaatgtaggaaattctctcccagtgagacctgtagagactaaaagagcgttaggaacattcactgttacggctggagtcttagggtgcagatctcttgagcacctgcaccatggcttggcccctctgctttttgacctcttccctccctgcccagctgaggcacatcctgctctggggagaagggtctatgcggtcctcagcccacctctgctccactccctttctcacagggctcattgttttctctttctctccaccctcctgggtctgtggtccacatggcactgacagcctctttcactgaccaagcctccgggactgacaattacaatcacccaccctggaaacagccataatactgtcaatcaaggcacagcttggattcaggagcacctgggacatgtccccaaacctcagacccagagggggtaacaaccatccctcagggacctcagggaatttcccagccccatgttaggcagtttggcctccctggccatctctgggctccaggctggcgacggtgctgattttcactatttagcacagaatggcagcctcgctgattattctctgattatctggatgctctgtgactccttctgtgcatctctgggatcatcattcagactcacctgcaccctgagcagtaacatcaatgttgtttgctatgacatttactggaaacatgacagggcagggagccttccctccctggtatctactgagattctactgagattcaagcagaaccagggctcagggtccccagcctcttctccgtgtgagtgggtgccgtcgccagtgctgaggctttccatatctttggtctcaagcttgaggatgaggctactcatggcacagtagtgcctctcacagtgccatggatgggatgttctctctaaaatagaagtctttttttttttttagtttggcccctttgataagtagattctataataattaaagaaaaaaagtaatgtcttttttggagagtagaaacactggtgaaagagaaaccgggaaggacttggcatggggggtgggtgggcttcaggccacggctctgacccccacgaaaggagagaaggaagggggattagtaggaactgccccagcccacaggcaggtcagacctcagacaaagcctcagccaactgagtgggttctttcccacgggtgcccattacaagtgccctgcttcctgcaggaagacctgcctggagggaccctggggtccccattgcctggagccagcccacgggcaggggacatgttagtcacttgtggtcctcctgcacgttctcccaaagaggcatctgagtgggacacttccacagccgccaccagcactgctgctgcattccccctcaggacaggggcagtgccttccttccccggctcatctacctgagccccatgtgaagtcaaagcttaggtgtctcagggctttcctccaacaggccctgcagccactgagacccttatataccctgagctgcatgctgtggagagagggtctgtggaagaccttggctcttagccatcgactcctctggggaacaccatgaaatcctcagactggggatgtcctctggagccatctttatcctcttcttcttcccagtatctcctgctccatgatctgggtcctgtccctggccctgttgcatctccagtgtctgatccatgccagcccttccttaaatatgtgttgaacccatttcccatttgcccaagaaatgagtgctggcaatgagctgcactttttttttttctaaatgggaaatgggtcaataaatgaatgaatgaatgaataacaacgcaacctgagtctcctgtcacatggttattttaagacctgcgtttttctttacccaggaggaaaatgagtacctgcagccgttattgcctctgaattgagctaacttgtttctacactgtcatgccatggtcacagtgggacagatgtacaccaagcctaccatagctttcagccctgcccttccacccgccccacctgtggcagtgatggcatcaaggcttccctcagagtcggcctctacccaccacacactctgggccatctcctgctctccaacagcctggggttcagtgatccctgtccatgtgttctacctcagagacacctgccactcctccccttccctaatttctctgccatcctgtttctccagcctcccaggaatgtcccctgcccaatctcatgtctcaggttctagaacttgtcctggaacttccccagagctgagtctctaataggagagctgatgacaggcacagccgtggtcaagccctctagccagcagatggaggagaatcagcctgagggccctgtgcatcctccctgctgcacacctgggcccatagccccctccaccctccatatgctcctgcagcccccacctcagtgtctgcctcagtgtctcctcccagcaccttcctcaggaagggcctgagatcttgcatggtgtgtttccccttggtgaactcctagtcacagcagcatcccgagtaagagcctcctggtgaagagatcgtcttggtgctccaccctggcattgtgtcctcagctccagggcaggtcacacgctttcctggaccaagattacatgcaggccacccctgctggcccctgccccacagagggaggcccggggtcaggggtggcaccaagaccacagctccattgatccctgtaggaattcttcctgcatgtttgaaagacaagagttacagaaacaaagcagagggaagattctgggtcattgcaaaaggagaaatttgcctgcagaccagcaggggacgcggtgagaccttctctgtgtatttctgcaggacaggtgctcacagctggggagccctcaactgacagaggcccagggctgctccttcatttcctcctgggactctgcagccttgtcccatctgtgcctggcagagtcctctacacatgaccctgtgtgtggtcccagcagctgctgctttctctggtcccacccgtggggcaaactcttgcttcatgccagcctccctgtccaagggcctggtccctgcgagtgcacctgggggagaggcaatggggaaacacatttgcatggtcagcccctcctctgtgagcccagtgacgctgggataagagaggcctggggcagcccacccctaggtctgtggcctcagaggcagctgtgtccactatggccctgactcctctcctcctcctgctcctctctcactgcacaggtagggacagggctcagagcccagggtggtccccagcctgatctgtccctcatggctcagatccctcagcagctgcgccctgaccctgctcctcactgtgctgtgtctgtgtctgcaggttccctctcccggcccgtgctgactcagccgccctctctgtctgcatccccgggagcaacagccagactcccctgcaccctgagcagtgacctcagtgttggtggtaaaaacatgttctggtaccagcagaagccagggagctctcccaggttattcctgtatcactactcagactcagacaagcagctgggacctggggtccccagtcgagtctctggctccaaggagacctcaagtaacacagcgtttttgctcatctctgggctccagcctgaggacgaggccgattattactgccaggtgtacgaaagtagtgctaatcacagtgagacagatgaggaagtcggacaaaaaccaaggttttaagcttgtcatttttactgaactggttaagaacttcagtggttaataaaatcacattaaatacaggattgttgttaaaaatggtggcacattataactctctcccatttttttcacataatgcccatagtgactctaagcagctaaaatcaaaacacaaaaacttataccaatactaagaaatactaacattactaaccaatttccactagtaaaagagttgtgaaacagctgaaatacatccagatggcataatacataataccactatatacaagagttgtataaaattatgtatcatgtatatataaaattatgtatcatgtatatgtataatatatgaaataaaatgtcagcagacattaccgtcttcccaccagtagccagcaattctgccctgcctctagaataaatggttaccacgggttgaataggcgaacagccctggcagctctgcaggatgactctcactgtttgttattgttttatttttaagattgcttttctttcctattttttttgaggcagagtcttgctgtcagccaggctggagtgcagtggagtgagctcggctcactgcaacctaagcctccctggttcaaacgattctcctgcctcagcctcctgagtagctgggattacaggcgtgcgccaccatgcctggctaaagtttttgtattttttagtagagacagggtttcaccatgttggtcaggctggtctggaactcctgacttcgggatccgccgtcctcggcctcccaaagtgctgggattacaggcgtgaaccaccgtgcccgacctcttttttttttttttttagtttggttttgttagtttagttttgttttatctctttaacttgacagtcagagatgatccatgtggatctctgcatgggtctgggagctgcaaggctcctggtgcatggcccggtcccgcctgccttggcagggctcctccacctggctcctggaggagcagctgcgcccgactaccctgcatggagcccgcggcttagcggcagctcgggaggggcctgatagaaacttccccctgagcaagcagcgccaaacccaggccgccacccaggatggaggctgcatcacccccggggagcccggatcctcgccagggtccaccaggagaagagcacatggcggagatgagcctgcggggctgggagagagagaagacacggcgaagctgcaggtgaagacgctgcactaaggccccacccagaggctgaggttccccgaccagaccagcagcagcgaggctgcccagagcggcgccagcaaggtggttctctccaggtcggatcacaggagaagctagccttgcacctggcccaggcaagaagcaggacatgggcttacgcagaagaatcagcaccgattccacatcattccccatggcaacggcctctacggtgctgtcagcaagacccagtgctagacccgagcctgcaccaggagctgcggagcggagggtgcgccccatcccgatcgtctccaccactttagctccctgggtgagggtgacacggggaagcttattatcgcggctgcccaaaacggggcgtggctgggtaccctgtgtacatagggtagatgctgaatgtgaatagcactgaactactagagggaggctggagaggcccacagtgtctatctaccatgattcattatttgggcccagaggattgcctaaggcctagtatttggctcagttggctcagtaacgggcactaggatgcagtatttgatcactcctatcctaaccaagtacgacaactggtgcaaacagactcaaaagcaaaggcaacgcaatgaataacttgctcactctggggccacatatgctgaataaaatgcctacccttgaaatgtctgaaaaccttacaccctgggaaaattgcatacagaacttgtgcttggagaatgacatgaactctaatcagggtaataacacttgtaaagttcctaacagcttttctttccttttttttttttgtttttgagatggagtttcgcagtgttgcccaggctggagtgcagtggcgcgacctcggctcactgcaagctccgcctcctgggttcacgccattcccctgcctcagcctcccgagtagctgggaccacgggcgcccaccaccacgcccggctaattttttgtatttttagtagagacggggtttcacggtgttagccaggatggtctcaatctcctgacctcgtgatccacccgcctcggcctcctacagcgctgggattacaggcgtgagccaccgcagctggcacttcctaatagcttttctgtgagtgtaacgccataatcatcttttaaaatgttttctcggaactaaaagttgctgggcgcctaaatgatgttgcatgatagttttgggtgattttactgcatctgtaattttctgtttaagtgagcaccgcttaatttgaaagctaatttctcacagtgtaaatctgttcattcctggtagtctattttctacaaaagtgtatttttacacaacattaaaaaatggtgtaccttcatctatgacagtacattacttttgacaagcagctttcaggcagaaattaagagaagtgttttatataaaatttattattttgaacagagtttgtgatttggtagttacgctgttgaaatttgaattttacaattcttagaaacttatattgatgcattcttgttaccaaatgattggcccattacattttgatacaaatagatttgttgttttggaaccattatttgtttagaaatggtcaatcttttagagagaaatacttaacaaaggattgtgggaagttttttttttcttcttctttaacggattgtaccaggtcttacttgaatgaaagtctgatgcttgctgatggcagagtgactaatctgcactagattgatgtttagagcagaatgttgggtgatctcaattgtttttatttatgtttgtgattttgttttaaggtaatcttaacatggtataagactctgtgacaagctaaacctactgcaatatagcatgttggagtcccctaagagttttaaaagctaatggcataaatgcctggagccaacctcggcagttatttcatagcagaagataccgtcttaatattccttttaaattcttttaaaaggcaaaataggatcatcctattttataatgtacaaatgtctgcagagattgtatggtttgttgtgttaatgtttcccacctaaaatctatcatattgccactttgcctaattgtagtcacatttattaagtaatgcagtttgtactttttattttgtaacattctgtgatttttgtacaacattgtatttgtacaatacagcaattcccagttgattgaatgaataaataaaatgtaaaatcatactttataaaaagatctatgtggctgatagaattctgacattcccctccaaatggaaagtgatgtgtttctttaaagtaaaggtagaggagtcttaaatataggtgttcctgcccctattgagaggttttcaaaacatgctcttaatttaacgtttaaatataccagagtcttagaatgtgagaataatgaaattggtttgttttaattttgtgataatattaaatctactggaaagaatattctcctttgaaaagattctcagctcagtgatcatagaacctgtacttgcgtttaattcaatgaggaaagacatagaaatgccacgttaatatcctcatttaggtggtttctcccttcactgatcagcctatgaatgtgtcaatgcagtactccccagtttaggcttaggtacttattgaaaggatgctgcctgagcatttttaataattgctatttcaagatcacattttggccatgaggcaggctgccactcactttaggctctgcctaggcaggaatgggtcctggaagacacatgttctctctctctctctctctctttcacacacacacacacacacacacacacacacacacacacacacacccctctcttctctctgggtacacattattctggacatcttcagtttccaggattctctatgtctccagctagaagtcagggcttagcctgtggtgatccagccaccctcaggttgaatctcgatgaagtcacaggaaccaccagtggcatggagggtaagggatcctgctatcaggttcagccaggaaatgctctggacacctgctggtggaagagtttaatgctgggcaatcacaagtcaggtcccttcttccagtcggcagttcagcctccctgactttctctgggttccagtcagtgcatgaggatgatggtgacatttattcaggggcagcacagcagcctcagtcaccaccaacagtcactgtcatatgagaaaattagatagaaattggccttccaactcttctgtcagatccatctttgccctttttctgcctgcttgagtgaatacgaccaagaccagctcaggtttttgctgatgctatcacacgtgctcctaaaaccagaaggcttaatggtattttctgtttatctttacggattcaatgaaaagacaccttttcttactggtctcccaatgaaaacataatcactatgtccacagtaacaaagatagccctcgttgttgtctgctgggatgagaagagcagcagaagtttggcaggtatggccctcatgggcttcacatgtccctacatctggccctggctttgctgatcaccctttgggctctgaacccacagggaagttaggtttctctttcttttgagattgcctctggaagagctgctctgttcccaggtgcagggcagcccctccgcagtaaggacccagctctcagagccatgaaggcctcaagcctccaggttgactccacatttctagtgcttgtctctggttctttggttggaaagatgttggatgaatagaagttctctgagacctaggctttgtgaatccaacccccattaaatccagggatctttttaacgaataaaatgaatcagggcccagtgatggtggggaaatgggacgtgagggttcctcaggccagtagtatggggagaacatccaaaaagaaaggaggggttccacttttgagaattgtctttttatatccatccacatattgacgaaaattataaaattagactaaaataccttaaatatataacatggtcaaaagaaaagaggtattaccaggataatattaaatagtaaaagaagtcagaggcgaaacagagcaagagacactttttttctgacagcatcattcttatgggctataatgccaaggcttgtgcagtaggagctgaaggaatctcacaggcgaccctcacgacaataatgacaataacaaaataagtcaacctctaaaagaagcccatgtagaattatccccaggtatgaaccacctggaggctcagcagaacattaagccttagattgggttcaagatgaccacagactggtgatgaccacaggcccctgggagcaacacactcacacgcctggtgatgctgatatctggtaaatcatcactgtgcatcctgaaacacattctgtgattagctctttgcagaccataactaacatgaaagaaataatgcctcagctgtaaacactgcagagaggacccactcattctactcccttaggtcatgagttgaaagatccatttgcaatggtcaggatgtccttccagaagagctgggtctgttctgaggggccacccgacttgggatcggagcccagcagggggtgctgttggactgttcctgagagggcagggctctgggccaggccacataggaaaatactggttctcatacacttgagcaagcagtgtcctcactgaagtatgacttcctgcacctgcaccaccgagcaggagccacttcctgcacctcaggagccactgagcactagactcacacgccaatgcttcctattttatcctccgccctcatggagtccttgtccaagcctgcccttcaagcagagacaaatcacacagcaggaacaaatttgctcaaaggaacttgaactacaatgtttcctgggcacagaatgagaaacacttggaattggggaagttcccatcctaacaacttagactcaggaagaagaaccctggagcttctccagcatggccagaatctcagtccacttcaaaatcctcagtctttagatcaggagttcttttagggatgaggtcaaggtttctgggtgcacattaccactgcctttcagtcctatcatctgggcatgaggagcttgttatctcgttctatccattatttctaaacctccttgtagagggctgggttagagagtgctaactgccatttatacagtctggacctttgtataaaattataaacacacacacatacacacacacacacaaacacaaacacacatacttattttgatgttccagcgaaagagtaaaactaaactcaacagaaacagaaacagatttgaataatacaagacaatctcattaatgaacatagaagcaaaactctctcagaatattagcaattagagtccattttatatcaatgaaggattatcttgagcatctgggaggatgtgggttgagacatttgcacagtcattggaagacagtgaacatgatttttgaaaaaacagcatgtttagagatatcaaccagaggtcagatgcttcaatcagagaaagatcctctgagttctcagggctgcttccctgaaaagctacgggagaaggaaatggagtgactggacacaatgccaggggattcattgaccctttggcttcccatgggcagcatgcatcagcatggtcttacaaggatgaaaaagggcatccctcaaaaaagaccgaccatttccccagaaattaataaagaaatatcatggccgggcgtggtggctcacgcctgtaataccagcactttgggaggtgggcggatcaggaggtcaggagatcgagaccatcttggctaacacagtgaaatcccatctctactaaaaatacaaaaaattagctgggtgcggtggcaggcgcctgcaatcccagctactcaggaggctgaggcaggagaatggtgtgaacccaggaggcggagcttgcagtgagcctagatagcaccattgcagtccggcctgggcgaaagagcgagactgtctcaaaaaaaaaaaaaaaaaaaaaaaaatcacagtattttcaccagtgcatttctgtttgagcgaatatgttgggtgaagaaatatataatatatacttttctaaatgaaatttttatctcacaaaattgtagaattaaatttttgttttggataagaaatcaagaaacaatcacacacattcttatgatctcatgaaaaccaggtataggaaaggaagtgacgaccccaaaattcatctaaaaagtgaaggttttggttcaaagataagagggttgtcatgttcaagacaaagtcactaccattcgtggtatttaaagctgttggtacaagtgcctatcattgccgattcccttcaaatttcttgtgtatgtttggatcttaaacatgagcacacacaaaaagagaaacagcaaaactagaaaacagatttacctttttgagtttccaactggaggagaaaatgaacaaagagtaagaatatcacatgataatgggaggaggagtgttaggaaggtgatgaggagcagttcagccttcccagcttggggacagtcttagtggagcagagaaacctccttcctgctgccacctgactctctagagtagatgaagaataaataactaaacataaaaagcccttaggaaaaagattgtcatgatgtcagtgctattaatagttcagttaataattctgtaagaatatgcaaaaacttactggctttttaaaaatttttatttatttatttcttttgagacggagtctcgccctgtcgcccaggttggagtgcagtggcgcgatctcggctcactgcaagttccgcctccagggttcaggccaacttactggcttttatatttggaatcacaacctgaaaggctgcagaacatgaaaggaagaaaactcagattgcagtgttcattctcttttatattatgagtttcctgcaagagctacatctgttattatgcaaaaacaaacagataaggaaacaagaattatccagcctcaagagtggaataaaacatgcactttttttgcttgtaggcataggtgagtaattcagacacggctgctgtgggtgactcatttccccttatgatggagcctcagcaaaaaagcttcacagattggggctgatttggtatgaaggggttggaatcgactgaaggtgacctcattgagagtctgcagtgaagccggccttggctgaatgacctacctgaggcctcccatgtggcctgggtttccaggaagctgggcagtcccagagaattcagagctctgacttggtttataaagtgtcacttccacagaaactgtcagtgccgagagatcactagtgccagatctggttaacagggaggggcctgatctcacccctcaacggaaggtgacgggaaaacaaaggaaaagctgtcttcacatcaacatgggcagataccactttaaagcatattctgtagcagggttcccactccagaagctgtggtacaggatgtgtctcctatggcatgggccaagggagggtaaaggtgagtttgacatctgtctcagtcaccatgaggtttttctgacaactaaatataaatatgtaaggtgtctcacagcacaatcatgtgacaataaatgcagtgcgtgccttcaatattgctctatcaaggaggctttccctccactccaggtgtgagcacgtggcttgcatgtccctccactccaggtgtgagcacgtggcttgcatgtccctccactccaggtgtgagcacgtggcttgcatgcccctccagcttcctgcactgtggtcatactgctgctgcctcattctcagcctgagcatccctacacaggcacaaactctatggctcaggctggtcatcactctgggtccacagtagctggtcagagagaaactgtcttcagccctgcccagcaggagaaaagagcattccagactgatcagctgggttcctgccatccagaagtccttgtctgtctggaggctcaaaacatgactgtgattcctttgaggactcctcccatacccaggctgtgggcttcgctgccctcctcaggacccgtgcagcctgttctatccctgcctcagctgcaggcaaagctgcttgccacaagctccctgctcataggatgccggagtcctcccaagggctgctcttcctggagaagaaggagaaccaggcagtaaggtctacctgagcatcatgggaaggaagtgatccgattctgactccggtgggcgcacacccttggtgctttgtgtctcctgctatcccagccacaggagtgggggaaatgtgtgagttgtagtcctagccgggaataatccataaaaggtgaaggtgagagaaggacactatgcatggtgtcaccttgttttcctcgttgtttcagcggcctgagtcctgtgtttcctgaaagatctgtggctcgaggtgacacgccctatcaggggacaggaatcaaagaggagaatctctgatggaaaaattcacaaaggaagagggagataaaaattgggcaacatgctcagggtgagaacgatggctttttgtccttgtgatagtttgctgagaatgatggttttcagcttcatccatgtccctacaaaggacatgaactcataattttttatgggcaaggacaaacaaccaaacaccgcatgttctcactcataggtgggaatcgaacaatgagaacacatggacacaggaaggaggacatcacacaccggggcctgttgtggggttgggggagtggggagggatagcattaggaaatacacctaatgtaaatgatgagttaatgggtgcagcacaccaacatggcacatgtatacatatgtaacaaacctgcacgttgtgcacgtgtaccctaaaacttaaagtaaaataaaaaaaaaaagacggctttgtgtcaagggctatttatttagtgtctctcgttcccattattaaataatttaacaacaaaaattgccttttctatgaattttcaggaaattctaaccatcattcctttattaaatatctagatatgtacatctacacatatgcatatacatgtgcatatatagacatatattatattatatatatttgtgtgtatgcatgtgtgtatatatttatatatatatacatgcatgtgtatatacacacacaaagacaaattaagaaatatgggaatatagtatacttctttaatttcttaataatgtccatttatatctaaaaaaaagatacccctaaggttgaaccactagaatcattttatttttaatgtggaacaatagaaagcttatggcccataaagatattggataacatatttttctagcaatatgagaaataagcaaaagtgtaaaacatttaaatacaataatttaattcaaaaatatgaaataatttgtattttttagttgctatgtttatctaccaagaaggcattatattattctgatgttcttacacattgttgaattaaagcttgttaaatacaaatgttatcatatgtgcaaatagcatatcaacatttctttttctctcatatattttcagaaatcactttaaaatgtagcagttcataatgttgacaaaatatcaaaatctataaactctgggtttaaaaaacaatgaaatacacagtacacataagaaaatagtgtcaaagctcactactataagagacaatgatcaatattgaaattttctcttacatgaagacgctcaaaacattttagcagtgactagtgaggttgtatccattctcttatgtttatatttatgtttaaaatattgtccttgagaaggagtgtaggtaggtataagcagaggtggctgtgcggatccaagattctagcctgcccccttgatacagcccattaccctagtcccatccaatctcacacatggcccatcatcatcttctgacttgagcggggagagagacggtgggtagagagggaggaaaggagttagttcagagcataggagacgtggtcagagagttggcagagggagggagggaggcacattctgtgggttcacgtggtgctttgacaactgtggatttacttctgaatgaagcatgaagtcattgagagtgtggaacagtaaaatgatattgcaaaataaaataaactaagattccagtgagcatgttgggaatcacaaacactcacagctgggtgaataaacaagtgctgccatctggagaaaagttcctcagcacacaaggagaagtgtgtttgcctctgtcaagcagaagtccacctatacagagacacaaggaaatgtttataaagagatccttattcggagcaaagtattggaagcaacataggtgttcaacacaagtggaatttataacacaaggagaagataaaatgctagccagttggaagtaatacaacttcttatgcgacacgaataaaaatataattatcagttgaaaaacaataacaacaaactcccaccaaattaaacaaaatcaaaagctctcaagaaaaaaacaatgtgccacttattttaaagcagaaacatgcataacgaattcttcaagcttatataacgggctttttggaaagtagactggaggcacattatttcacataaatgggtgtcttaggaagagatggagacacgtataatggctaaaaaatgaaataaatccatagagaggtttttagtgtctagtgataaaagtactaataatattacgtaattaaattccaaaaaattaatacagaaaaatattcttgatttgggggtggtaacagatgattaagtaaagcgagtctacatgagctgctgatgcagtggatgacaagctctctgcagctcattgttagtgagaaggcactgctttgccagaaaccccttttatttagatttctcatggtccctgggtccctctccaacaccatgagcagcttcagaagaggatcaggataaccagtgactctctggctaccatggcccagttgtgtccgagaggtaagaaaggtttgggatcttggacagagtgggacagtgggagaaattcctgagatggccccaaccagcctggaaaccactcagaacctgcattgaagtttagccatcagggtgctcttgagactcggtttgggctgcaacacagacctgtggggacaggggtcaccataagccaggccacctccacccctgggtcagctcatctcctccctctctgcttcagatctttgagtaaccagcacatggaggcccgggaaaagtcagagagcaagatcttatttaaatgctgtgactccacccccatgaaggctttgggagctataaaaaagagacttaggggagcccagtctccaaacagagcttcagcaagcatagtgggaatctgcaccatgccctgggctctgctcctcctgaccctcctcactcactctgcaggtgagagtggaccttacccagggatctgcacccacctctgctccagcttctccactccctggctcagtggactctgatcctgctctcacattcctttctgtcccctctacagtgtcagtggtccaggcagggctgactcagccaccctcggtgtccaagggcttgagacagaccgccacactcacctgcactgggaacagcaacattgttggcaaccaaggagcagcttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcattggacagcagcctcagtgctcacacagtgcctcaggccagtggggaagtgagataaaaactcaagagctccctcggcctcactgaacaggcctcacagagcactgtttaaactggaccacccaaaagacaagggatgcattcacaatagtgtacactatttaggactgttaaaaataggaacatgaagtgaaattagcaagcctgccttattaacaaatgtgtgtagggaacatcattgtttatatattagtagttacatatatataatactagtgcatgaacatacatatgcactagcaattagtaaaaaagaaacactaggtttaactaaggaaatatttattattccagagttttcttatccattccatttgaagatgctgggatcaagtcaccgagggtgctgctctctggccttgagaatccactcagcagggccaccagcagcccctcccttctgtggcctgctcatgccctgtcttctcattagaatccccttccctgctgtcacagggatccctggactcctccagatccaaatatgtccaatacatttggttgaggcctcctgggccccacattactgtgtaatctcaacacccacacactcaaaacagtgttcccatgcgtattcttctttcgactcatcactgtcctctaacagccatgggcagtgtgtggagagagcaggtgaagttggagctttggggtacagttgacagagatgttgacattttgagaaaaagaaaacacctatatagctgttttcaggataattttccatcaagataaaaatccacgcatgagagcatcactcttccagtgatgaatgcatggaggatccttctcactctattgttgggtagtgacacctgggaaacttactgtgttatttagtgtgcagacagctggtaaaccactcagctgactctagggaagttgaccaaacagtgtccccactgatgtgtgacttttctccacccatgaggccccactaccctgtcacctcctgagtccacctttcccattgcgttgctttagatttgaggcatctctctcttacctctttaaagtctttacccaagtctggttcaggaagtgctgatacacggtgagaacccagggtgcatatggatggagtgattctgtgcctaggagagcctggccaggggatccaacacagcttgtggccatcctccccgcagtggagcttctggagacagagctctgaggtgtccccaccacaccctggggcctttctccctcagttctttataaaagggatatttgtcatgggcttaggggaagaggccgctgaggtcacacaagacctgccttcttgctctggctcacaaggcacaagtgagctgtgaccctggactctgtgtcagtgctgtggtcacttggtcagaactaagggaagctggagaaatgtgggtagctttgatgcagtctggcaccagaagctccatcctgaagcactctgaaggtgctgatggctgttcactgtgctgcaccctgagcaggaggatgatcatcatcgcagacctagggtgacagcctcagagctgaaatattcctcctggccctgagaaaagtgggctaaagttctcccttctgcgtgtgttacccagtggtttgcccccctttcatcacctgtgaccaacatgggctcattggggatatttgtgctgtcatttctggcacaagaacccaaagatctaagaccataaaatgcatttggtctttcatactgtctattcccatcagggcagacatctatccattaatacattttatttaattttcttgtcttatattttcagagcaatgatgagtaatgagtgaggtaaggggtacctttgcatttttttgatctcagggaaaatgtcctccatgcagtaagatgatgactccggaccaagacaggtgtgtgtgtgtgtgtgtgtgtgtgcgcgcgcgcgcgcgtgcgcgtgcacacgtgcacacgcatgtgtgttaccatatcataaacaaatttatctgtttctgtattcttacgtgatttttattagggatagatattaaaatttgccaaacacattaaaaatctattgatacaatatgatctttggttgtgatgtaataatatggtattataccaaaacttttattaatgttgaacccaaccattattttaagtataaatcccacttgacaatggtgtataaatgcgtaaatctggtgttgaaatcagttcgttcctcaaatttcctggttcaagtgatcctcccacctcagctccttgagtagccgggattccaagtgggtgtcaccatgcctggctaattaaaaacaaatcttatttgtctcaacatattgcccagtctggtctcgaactcctgggcacaagcgatcctcctgcctcagcctcccagaatgagttaacattttattttaaaattttgcattaatatgtttattttattttttatttttaaaatttttaacttttattttaaattcaggtggtacatgtgcaggtttgttacaagggtatattgtgtgatgttgaagtatacaattttatctttttaaattgctcttaatacatatttttaatttaaatttcaacttttattttaaatatagcaggtacacgcgcaggtttgttacatgggtgtattgcacccgggttgtgagcattgtacccaacaggtagttttttacaccattccctcctctccctccccctcctagcagtgcccagtgtctattgttctcatgtttatgccatgcgtgctcaatgtttatctcccacttaaaaatgagaacacgtggtatttggctttctgtccctgtgttagttgcctaggattatgtccccctgctgcatccatgttgcttcaaaggacattattttattcctttttatggatgcatagtattccatggggtatataaactatattttctttatccaacccaccactgacgggcacctaggttgatcccatgtctttggtattgtgaatagtgtggtggtgaatatacaagtgcatgtggcctttgggtataatgatctatttgtctttggatagataccctgtaatgggattgctgggtcaaatggtagctctgttttaagttctttgagaagtcttcaaactgctttccacaatgcctgaaatacggtgtatacgtgttttctttactctacagcctcaccatcagctgttgtttttttactctaattatagccattctgactggtgtgacatggcgtctcattgtggttttgatttgcatatcttgatgattagtgatgatgagcatttctccacagttttgttggccactaatatagtgcagttttaagttcatagcaaaatacagaagaaggtagaaagatattccctatcctccctggctccacacatgtccagccttcccccttatcaacgggtcccatcagaaatgtacatgtcctgtaattgatgaaccacattgacaggtcattatcactacaagtcagtattttccttaaggaatttttctcgctgatgcacatcctatggctatgggtttgtgcaaatatataatgacatatatccaccattacagtatcatgcagtgtatttcccttccctacaaatcttctggctttactgattcatctctctctctcccctaacctttggaagtcgatgacttttctacttttttcctttgtttgactgtaatacacttgaaattatttccccctttttggactgtaatatacttggaatcacgtatcatgtcatttgcaggtcagctccttttacttactaataagcatttaagtttcttccatgtcttttcgtggtttgatagtgtgttgtccataaacatgtagaatatattaatataaagtactttggagctgatcacatcactggccattcaggtttttcaattactgtttgttgaatgacagtgaccagtcagatgacaggaagtcttagaccccctgagaacacagaagatggactgaggatgtcagggtcaccgaggactgcactgggtgctctcatggagggctcagtaggggtgtcctctagttccagtgagcctggactgtgatgggcactcagagaagggtcctctctagcctagcagagcccctgctcacaggcctaccagctgtcccagcagctttccctcccaggtccttccgtggggcagacagagtctcactgcctgttagcccttcctacccacaagaccctcagcaaaagatccttattcagtgctcagggagaggtggggcagatagcagctggggccacacctgcatgaccagctcctcctcgctgaggcctacagcaggtaataaactcaatccatcccactggaccaaagggagctgtgtctaccatggcctggacccctctcgtgcttgtcctcactccctgcacatgtagggaaaaggcctagagacctggggcagttcccagcttgtgtcagcccctctggctcagacttgccaacagcttaaccctgacacctgctccaacaatgtaaatgtttgcatttccaggttccctcttccaggctgggctgacccaggtgtcctcactcccagcatcttcatgcagatcaaacactcacctgcactcagagcatatcggctttcatatcggtggcaaaaataccttcttttccctacagaatccagggagccctccaactatgttctgagattatgctcaggctaaaatgagtaccaggcctctggggtccccagacaattctctgggttgagaggctcctccagagtctcaagttatttggtcgtctctggccttcaccttgaggatggagcagatcatctctctcagatgggctgacagggcatggcttacactgtgctctaggccaatgggaaaatcccctctgcttgtgctgcctgggctcccactaggcccctgctgtttgtgacaacagccagcactggtggtgacgcttcagccatgtatgccctacggtgagagtctgcagcccttccacgcaactatcacttgcagaatgtctgcatcattgctaatagcacattctgagcctcctcacgtttctgtgggcaacaatttccttcccaagacgtgcacatgatacaggagatttatttaccaaataagtttattaggaatccaattataattagaagatattcatcagtgatcgggggaaatacctggtataattaaaatagaatttgatgaaaatataaataaagaactaaattatgaaggtgtgggcagagagtctggacaccctaagggagatggaaaaccattcatccttgccaggaatgaatgtctctgggatgcttctctaacaggaggaacctggagtgagaccaggaacctggagaactagcagctgggtgactggaaaggaaaccatctggggtggggttgggtctgcaaggcaggaggtgtctgggcagagaaagcagggctggggcggagggtcctgcctcatcccattctcctgctcactccttcctagatccctgtcagggcagtaaccatgagcaaggcttgaggctacttcttataaactgtggccctgggcacattccttagctcacctgagcctcagtttcttgatgagaaaaaatcgggacaatagcaaccaacctatctcagagggctgctgtgagaccctgagccactgtttctcaaactgcccctgagatcacctacaacagaatggctgtagggtgaagtttgagaaccgcagtataggtgaggtggtgcgtggggcaggccctcccacactgtaaagtgcagtgtggtgcggtaaaagctgatattcccgcaggcatcctcagagtgggcccaattagactcttgagcactgattccattcaaggtctgcggcttagagaggatggcaaagtgaggcaccaccaggagcttgtccctatgggctccaggccaaggacgtgcctggagatgactcctgccttgtggcgctgtcactgcctcactgtccacattccatcacgcctcagatcctggcttccaccctggtgaaaggaatctttcaatatcacccacccagccacagacgcttctctgcttctctggcaaggctgcaccccctggctaggtgggcagggccaggggctccttgagacagtctgcagccactgagctctccagcctccagggcagaggtacagtcccatggagcgtggctgatctgaaggcagttctggcctaaaaggggtcttgtcccttcctcgtcctcattgctcccaaggccaggttggcagcagtagcagcggggttggatgctattggatgggagaaggtgaatggactcggagtgcagaatcaagctgcggaagccaagggccttgaaggagggtcacacacaagggacaactgcagaggaaaataaaggaacactttgtgattagccctgcctgtggctgaaagcgcagtgcagaagcatagtaaggaaggactgggtggtctgggtttaagacctaggaaccgtctctgctcctccaagcctgaatgagccctataacctaagggtcctggaggtcttgaaaccttctgcggagaaggctccaggtccactgggccctgtgggtggaagagcagagtcacagccccgcactggggacctaacaggtgtggccttgctagggccccagaatgggaccagagtgggtgggagggggcagaagctctgagagcaccccctccttcctgaagcctgtgcttctgagacacatcccaggaccctctatgtggttccccatgtctctgtattttcattcagcttcgagtagctctccaaactgtgttccagggaacccccgtgttaacctgtgagggcctccaggaagggggtccaggtggggtatgcttggtgggctctgggtttccttacaggagctctcatataagtcctggtgcagcctgggaatctactactgagttggggcgggggcgggtctgagtccgaaacattcctgacctgcccctcaaagaaaggtcccactgaacagtctggaaagctgttttgctgagctcccgtcatcactcaatgaggcacgggcggagtgtggagggagtttccaacacacagtggatcccgcacaggtgtctctcctcgggtggctggggaggggagcacaagaaggcactgaggtcagagggcagctgccaccagcacctggcaccacagggcagtctggcctacagggtattttctaaacctggcatgtgaatgggttccatggggcacccagctgcctctaagaccataaggccttgttgtgagaatgggaattgcagcaggtcctgggaagctgccagacgcacacgggcaccatgtacagggcttctcagagatgggagcagggagcaggggacggagaagcgtggggtcaagagcgtggccctgagcagggggctgcagcgaagaccaaggggattcataagccagatccagggagggggtctcccagccccacctgctccactaaactcctctcctgccggagccacagctgtcaaggccgccttccttaaggcatcagggccactgcttgtgcacacagctaccatcagcagcacggattgagatggggtgtgagtgcaaactgggtctattccccagggcttcagggttggggcatccctgcccgtactgccagggtgtagggatagcagggagcactctgggcacgtgtatgcaggctgaagggagacgtattgggtttcggagagggaaagagggccccacaggtgcccagggacacggtaacgctctgacatcgctgcaccagcaaaggggccccagctctggataagataaaatgcattttaatagtttgaagtgccatgaggtgtctgcatggcactgcagcctgggtgagggaggacagggtcatcatacaaagtaggcggccagggctgacatcttgtccttgggccgtctggggttgggcttcccagggggcctcctggcccggccccgccctcgaccctgccttctccctggtccaccgcggtgcatggggtggcaggaggccgcatgcttcagctccaccagctcctggaagacggggtcacaaaagacgcagcccatgtgctgcgcctcatcgcccgggagtggggacttggccttgttgaagtccacatcaagcaaggcggcctcacagacactgcaggtgtcggcggacacccgcacgcggtgggcgttctcgaagcagtgcgctaccacgttgcacttgttgcaggccaccttccacttggggcccgaggtggggtccagcaccagcaccccgctctcacattccacgcactggccgatgcccagcatgctcagcgagtgctggcaggaggggtgcgtacactcgttgcagcccatgcctggcgggagaagggagccctgtaaaggcacgcccactgtgcccacctgccctctgctgcctgctcccaatgcctcaagctcctggatccctcgtcccagcagaaggaactcttcttggccttgctcttggggacagccttgctcatgtttcggctcctggctgccattacccctgttttctgcttacctgaaacctcctcaactttcaaggcccctcgctggcgccatcccagtgggtttcagctgactccatcccccctttgctttgctgccagcttgttactggtaatgccacatgaccctcatgtcactgggccacatgggaccaccctgtcagctactctggcggcagcaggagggcagggatggggtctcactcccggggcagcctgggtgcagactgaggcctgagggggctttctgcagagcacacggtgaatgtgggcagatgcctcactcccgctgattcctggtctggctcggtgctctgtcctgcctgcctggacatgcgctccctcctccagtaatgaggacgaggatgaggatggaggacagtggtggacgctgactgggggtgcccgctcaccgggtgggtcccccgactgctgcatcctcttgctgactcagctccagagggagcactgcacacctgcgcccaggtcctgagggtggactagggttgcctgctcgattctgacacagagagagggtggcaccactggctgaggcctaagcagtgccccagctacatccagggtctctcgtctcagtgccaatgagtgcaggaaaggccagggtgaggggtcccctcagagtccagcctggtgcaaggcaggggttggcactgaacagagactgcagctacctgtggacaggagggagcggctgcactcaccttgatgctgctgttcaacaatggattgctgttgcgcctaaccaactttaagacttggtgggcttgacacaacttaccttgtgataggcagatgtgaatgtgtggtcaacaggtatcttatggtcctccgctagggccaacagcactgcagaagttgttttacaaaacacatgcaattcattactgcagactgcacttagccctgctaagtgcagggctggagggcctgtgctgtgattctcccactggagctcactgcaaattccacatggcatcttttcttaccaccgacccctccagtcccctaaattctgccgagtcttatggcccaagcagcagggctgttttcactgcagccttgtcaggcagcagatgacttttctacgccaggctgcattcaaaggtggcagccttctgtagaccaacgacataggccagaagtggaacatgctgttcccaaaacctgaagagttctgccaggcattatgtttggacgatctgacccatcctgccttgaccacttaggcactcaaaactgtactcacgtgacagttccctgaatcttcatacagattatctcctaccctttatagtgcatgtttcttatgaaggcctccaacatgctagccatttcctactaaactaactcaactagcatgatgtcaacaacacagtcaatcaatgggatattttgtggggtgctcagatggcagaatgctcccacatcaataaaactcacccttatctaatcttcatgttctggtccccctctatcacccaccctcatgatccagtcccatgcctagtcccttgactcctgctggtacctgctggttaggtcttatggctcctctggtgtgtagtcccttttcttccccttttaaaaaatgttttgagacagggtcttttctgtcccctagactggagtgcagtgtcatgatcatggctcactgcagctttgacctcctggggtcaagtgatcctcatgtctcagtctcctgagtagctgggactacatgtgtgagccgccaagcctggctaattaaaaaaaattttttttttttttttgtagaagtgaatgttccgctatgttgcccaggttggtctcaaactgctaggctcaagtgatcttcctgccccaaactcttaggctcaagtgatcctcctgattttccttatccccgtgagcctcctgaagtgctggggttacagatgtgaggcacctcacccagccttttctctcttctcaaaatgagcacatctcctgctgtgttgtgctgggacttaaccctagttctaggccaagagggaaattgggcaagatggtgaagaaggcatattttgtcctagtgagagaggcctctgcaaacaaaggagtttagctctgaataggctgagtttagtccacttctgcaggctcaggggattaaggaaaatcagtgacttaagattttagaggcctcaatccaaataactctatcaatatatatgagggtgttggccgggcacggtggctcacgcctgtaatctcagcactttgggaggccgaggtgggtaaatcacttgaggtcaggagtttgagaccagcctggtcaacataaagaaaccccgtctctactaaaaatacaaaaaaagaaaaaaaaaaaaacaaaaaaaaacaaccctggcggggcatggtggcacacacctgtagtcccagctacttgggaggctgagactcaagaatctcttgaacctgggaggaggcagaggctgcagtgagccgagatcgtgccactgtgctccagcctgggcaacagagcaagactctgtctcaaaaacaccaaaaaaaaaaaaaaaaaaagaaaagaaaaaaccctgacttttctccagcagtctggatcaatcaccccaaacagtccagtgacccctgatggttgagcagcagcactagaaccccaaatttctaggggagacccagcttccagtttattaagttccatgcacttaattcttgttctgcttgattttgggtcagcagttacatgaactcacgtgtttctcaaccagtgttctggagatctggctcagtgcagggctgtggtttcaaagttattcaagcaatgccaccaaaagcctgtaccccagaatacctgccataggccatcctgtctatccctggagacagtcccttcttattgaagatgaagcactttggcccgtagctggttgccagagctttcagaaaagcgtcggagtaaaacaaccatctctgatgacaaaagacttaaaatggctgtgaagagctctattaattcctcaaatattcattgctctattttttatctccttttataactcctactgccaggctattggcctttctacttctatcctctccccgacattcccatcttagtaaatgactccacaagtacttcagctcccattcaaggaccttggattacccttgggtcctctctcttactcaacagcccatcctatgccaagtctcaccaattcttctctctctctacacacacacatatacaaacttatttgtaaacaattattttaaaaaatctctcttctgaggttccagctttcttcttcttttatttttttgagactgagtctcgctttgtcacccaggctggaatgcagtgacacgatcttggctcactgcaatctctgcctcctggtttcaagtgattctcatgcctcagcctcctgaggagctgggactacaggcatgcatcaccacgcccagctaatttttttgtatttttagtaaagacaggatttcactatgttggcctggctggtctcaaactcctgacctcagataatctgcccaccttggcctccaaagtgctagtattacacgatgagccactgtccccagcctctctctcttttttttttttttttttttttgagacagggtcttactctgtcgcccaggctagagtgcagtggtatgatcttggcttactgcagccatgatctcccaggctcaggccatcccacctcagcctcctgactagctgggaccacaggcatgctccaccatgcccagctaatttgtgtattttttttgtagatacagggtttcactatgttgcccaggctggtgtcaggctcctaggctccagtgatacccccacctcggcatcccaaagtactgggattacaggggtgagccaccacacccagtcacagctttctttttagagttcaccacagtttgagtgattatttggaatttttaagtggcaaaaattacaacaatatatttgtaaatgaaagagaattgtgaaatgtatttgaaattttaactttaagattttctttaaaatacccatattgaatgaagagtatcaaagtaactattgcttaaaaaatggggcttcatttgggttaaaacacaagaatcatgaacatgatcaaaattcttcaaagtgcttgcttggaatgatacagagaggattagcaaatacaaatagtttttttttgtttgtttgttttttttttttttttttttttttttttttttaagagatgcggtctcactatgttgctcaggctggtttcaaactcctgagctaaagcaatcctcctgtcttggcctccccaagtgctaggattacaggcattgagtcaccactgctggccaagatgctgatctttttgttgttgttgttgttgcctaggctggagtgcagtggcctgatctcagctcaccacaacctccgcctcccagattcaagcaattctcctgcctcagcctcctaagtagctgggattacaggcatgcgccaccacgcccggctactttttgtgtatttagtagagaggggtttctccatgttgcccaggttggtcttgaactcctgacctcaggtgatccacctgcctcaggctcccaaagtgctggtattacaggcatgagccaccgcgcccagtgatgctaatcttatgaaagacaaccaacaacaaattctgaatactaaagtgtgcgaaatgtatttaattcttttcatagcacagatgagttaacccacgatgtgttgtcccaggcactatggagtcatcttgaatttcatgttctaaacaaacacccttggcctggaggaatgcacctgcatatcacgacaggacctagtgtctcagatttagtccggcagctttgaatttggaaatcctctttggagcttcttctgacacagcatcttttctctctgggaaggtaggtgacacctgagaacagaggcatggtgtggcatcagagatggaggtaagaattatttttctaccacaatcccaggaaaagactctcctgttcctggtgagggtgagagctctggctgaggatgtcctctttcttctttcttctccagaggatttttcagtctctctgcaaatggctgcttcacagccagggttcatcgaaacccctggatcgtcatggccagtggtttgcgtctctccagcgccactccatacgagggtctttctgcatcctgctctcatggtggacttctgagggccatgctcctcatttgcagggctcacaaatattctgtaaatatccaccagtgttctgataacggggtgacccaggacaaactgaccgtctccagggttcaggtcccaggcatgtctagctccctctttcctttcactgaaaactaatgtcctgtttttttccgtatctatatggacctttctgggttcagtggtgtgggaaaaatagattgttggtgaagactcatcttcatctcctgaactgccatcattgcagtgttcagagtggggatggtgcttggaatcattcccttgaccttgccttcgaccttgcattagttttgactttaaaatgtccttatgaaaattcccccaagtacggaagcccatagtctcatcagagatcccaccttttccctgttcccctccatttttttttcttttttgaaatggagtctcactctgttgcccaggctggagtgcagtggcgtgatctcggctcactgcaacctccacctcccaggttcaagcgattctcctgcctcagcctcccgagtagctgggactacaggtgcccgccaccatgcccggccaattttttttatttttagtagagacggggtttcaccatattggccaggctggtctcgaaattctgatgttgtgatctgtctgccttggcctcccaaagtgttgggattacaggcatgaggcactgcacccagccccttcccctctgtttgtgaactccatcccaggatcatggttgagttcacccagcaggttttcttgcctctccagttcttccagtcgagcccacagttcctcatttgtaagtaagcatccttggacttgagatcattttcaaaacctgaggttttggattttgaatcaggtttatgtgcaatccagggttttctctttaattcagacttgttttgaacatgttttcttaggtcaacaagatctccatccccatcaccccatccctgcagatctgctgtgaatgcaactttagattcaaagtttctcctggcttttgtaaagtcatgtagtgctttcctcacacactccttcctatgctccactaaccccactgcttgctttgcagagcactggcaaaaccagttgtccccgaggagaagagtgattttgctggtatccacaagccttcctggtatagaaggcaagaggcccagttggcaccatgagctcgtaagacagcctattgggcaaggtttggagtcgctcttggagggtattacagtccccctttaccttttgccagtgtgcaatttcatcttggcacctagagatcatcttttcctgttctccttggggcctcataacctgttgaggatgcagctgtttgaaggtggccgaggaggctgcacggtggggcacacggtggggctccatggctcctggttctgcgtgtgcgctgtggtcggcactgctcaggctgctgcccccagtcatggcgactgcagtgcccaacttcctccagctgagtcctcatgagatccttcctgcaatcagtgctcccagctcctcagtcccttcaaaagataaatcattccggagatgggcggtggtgatgtagcatgacaatgtggctactttcaatgctaccgaactgcataccaaaaaatggttaaaatgctgaattttatgttatgtatattttaccacattaaaaaaatattagctgggtacagtggctcacacttgtagtcccagcactttgggaggctgaggcaggaggattgcttttagtccaggcatttgagatcagcctgggcaacacagtgaaacccccatctctacaaaaaaactcacaaaattagctggccaagttgattgtgtgcctgtaatctcagcatctctggaggtggaggtcgggggattgcttgagcccaggagttcaaggcctcagtgtactgtaatcacaccactgcactccagcctgggtggcagagcgagatccagtctccaaaataataatagtaataaataatagtaataataataaataaataagtgataataaataaaaatatccacttgggataattatcacaagaactttgctgtcatggttgtgattttttggaacaaattctcatggttctaactaaaccaaatcaaatacaacattgatttgaacgcccatgctcacagcagccttattcacaaaaaccacaaggtagaagcaacccaaatgtccatcgacagatgaatggatcaacaagatgtggtctctccacacaattcagccttaaaaaggaaggaaattccaacacatgcgacaacatgcaggaactttgaagactttatatatactaagggtacccaccccctacctcactgtattcatatgttgaaatctcaacccccaagctgatggtattagggtatgggattattagattcaaagtttgggacataattaggtcatgagggtggagctcccatgatgggagttgtgaccttataaaagggattccagaggcccctcttaccccttctgccacgtaacaatacaacaggaagtcagaagtctgtgaatgaaagagggccctcaccagaacccaaccatgctagcccttcatcttggacttccagcctccagagccatgaggtatcaatgtctgttgtttataaaccacccagaccatggtactctgttatggcagcccgacctcactaagacactaatcaaaacaaaccggtccacaaaaggacaaacactgtatgattccacttacatgaggtacctagagtagtcaaattcctacagacagagtagaatggtggtttccaggggctgaggggagagggaaatggagagttgtttaatggcatggagttttagttttgccaaataaaaaagttctggattagttggacaacaatgtgaatgtacttcatgcttctgagctgtacacttaaaaacggttgcctgggcatggtggctcatgcctgtaatcctagcacattgggaggccagggcagaggactgcttgagccgaggagttcaagaccagcctgggcaacatagcaagactctgtctctacaaaacatttttaaaaaaattcaccaggtgtggtggtgcacacctgtagtcccagctacttgggagtctcaggtgggaggactgcttgagtctggatgttcgaggctgcagtgagctgtgatcacaccactgcactccagcctgggcaacacatagtgaagccgtatctttaaaaaaaacaatggtgagactgggtgcgttggctcacacctataatcccagcaccatgggaggctgaggtgggtggattgtttgagcccaggagtttgagaccagcctgggcaatgtagcaagaccctgtctccacaaaaagttagctgggcatgatggtgcatgtctgtggtcccagctacttgggaggctgaggtgaaaggattacttgagcctaaaagattgaggctgcagtgagctgtgattatgccactatactccagcctaggtggcagagtgagaccttgtctcaaaaaaaaaaaaaaatggataaggtggtaagttttatgttatgtgtattttatgttttttttattttttaaagaaacagggtcttgctatgttgcccaggctagagtgcaatggctattcacatgtgtgatcagagtgtactacagcttccaactcctcagctggagttgaggtgattctgcctcagcctcccgagtagctgagaccacaggtgtgcacagctttgcctggctccattttactacactacagtgtctctctttttacatggttgttgcagtaaaagaaaattcagtgtatatagaaacatcacaagcaattgttttaagattatatgtaaagtggaaataagttgtagactcatatagttgtcaataggttttctaacataagaactttgggtggggcacttgagaactgattcagatggaagatggctctaggctggtggaacagtgttgagaattcctgaatgtgtagtattcctagacctctgtccaccaaattaaagcaggtcccccatcaccatgatcctacagggggcatcccccttagtaacccatggaatctggcccggcctctttctctagcctaaattgagacattctcctccttgtttctctaggcctcagccacactggccttcttctatttccaaacacacaccaagctctctcctgaaacacagccttcccacacaccgcatctctgcctagttcatacactgccggcaaattgtgtattggggctgggcccttcccactgttcagctgtcatcctatttttttcctttgtcaggggtcctttgaaaactacgtattccagaccaggtgcctggacattctctcttatgacacttattaaaacatgttgttggctgggtgcggtggctcacgcctgtaatcccagcactttgggaggccgaggcaggtggattgcctgagctcaggagtttgagaccagctgggcaacatggtgaaaccccgtctctattaaaatataaaaaatcagccgggcatggcagtgtgtgcctgtagtcccagctactcgggaggctgaggcaggagaattgcttgaacctgggaggcggaggttgcagtgagctgagattgcaccactgcactgaagcctgggagactctgtctccaaaaaaaacaacaacaaaaccaaacaaaaccaaaacaaaagaataaaaaaaaatgttgttgtcattattttcccgctagactcccacaagattccccactagactctaagcttcatgggaggaggggctatgcacattcacagtgtctgctcttaccagagagtctcacagagcagccctaacaggttagaccaaagaacaggtcatataaaaacccaagttccaatttctcctgagatgtttttctcctaaaaaccaagttaagaactctaggcctctactgggaagctgcctccccattcagacagggtctccccattaccacaatcccttctagtcctctcttctacttgcctccctaggtgatcattgcaggcatctgagtttgtaaacccgagtttacaaaaggggattagagaaatgcccacatcaaatgatctcattcacccatttctcagattctaggtcctgatggttggcacatgttgcaatgagttggatggggggagtccagccaggacctcagggtagccacagacttcttcaatttccaccctctaaggtttggtcctcagattggaattatgtttcctcaattctctgcagacaggaagtgttgagatctgactcttagtagtaatttaaatgagagaaagagaggaggagggaggtatttttatatcctatttgtatctaaataccagaaaaggtagggagtgggggcttacacctgtaatcccgacactttgggaggccaagacgggagaatctcttgagcccaagagtttgagaatagcttgggcaacgtggcatgaccctatctctacaaaaaatacaaaaattagttggacatggtggcatgtggctgtagtcccagctatttgggaggctgacatgggaggattgttttagcctaggaggtcaaggctgcagttaactgtgattgtaccactgcactccagcctgggcgacagagcaagactgtctcaaaacaaacaaacaaataaacaaacaaacagaaaaacaaacaacccgggaaaatggtactttgggaacaaggaccttggtcaacccaattccttattgaaggaaataacgtatacagtggtccatttcttttttttttttttttgagacggagtctttctctgtcgccaggcttgagtgctgtggcgtgatctcggctcactgcaaccaccgactccctggttcaagcgattctcctgcctcagcctcccaagtagctgggattacaggcatgcaccaccatgcccagaacatttttgtatttttagtagagatggggtttcacaatgctggccaggatggtctcaaactcctgacctcgtgattcacctgcctcgacctcccaaagtgcgtgctgggattacaggtgtgagccactgcacccagcctacagtggtccgtttctaagacaaaatgctttgaattggcttaggtcagcaacctacagaagaaacatgatacactaggtccctgcttggatagccagccaatgcctgcttgtcagcctcccccttccccaccttcgccccttagttgccttcacctgaaccaaagtagtttagtctaagatgaaagtttactagcctgcaaaatagcttgttttgtctgttcttagcctgcccagctacttaggtcataagtctaacacttgaagagcccctaagctaactaagattacaatgcattgtgggctgcaacaaaatgcagcaaaacgaccctaaaataaacaaaaaacaaaaaactcctggcgctcccacccaacaatcaacaggcgagaagtttatgaccccgtagtactcagcctatgaggaactgggggagggacctgtgcactaggggataaactgcttgttgaaagtgtgctgggtgtgcctgtcagacacctgatcttgcaagactgtcattaaaagtctcactttcactgttctccgggtctccgagtccattctttgggttgggatgggcgagactgtttctcacattatgaaaagctgaaggttaagtgaacttggggaatactgcctcctgctggctggatgtcatggaagcctggcccatcagcagagaatgataagctggagttctggagggtctgatttccaaggaatcacccccttggaagctcctctaatacaccctgatgagattaacctgattaggtccattgtttgataaaaagaggaggaagtttaatcacttccacattctttgcccacgactaaccctgattggatttggggctatggttcaaatgtatgaccgattgatttttttcacttcttctgttggacttttgaaaaaaagttctctgaaaaggaatttagaggaaagagacttattccagtgaacagttacagtttgcaaacccaacagacacaacttttggtacaaaaggaagttacattccagagaacaaggggaggctttgtcttttctagagaaaattcccgctcagaatcccactcaggtctgcttatgcaaatgaaagattcaaactttttagttctgattacttggctctagctgggttctgattagtcaaagcaggtcacagtctactggtggcgtaaacaggaacaggcagctatgtaagtcccaaagtttttccagaaactcaaagtatgtgtgtgacctctggtcagcaaataaccacttgtctcaaatttaaattcaggcccaggattcatcttgaggaattggctctttcagggttcagagaccaatcaaaatgtctatcagaatggatgtgttaaaaggcaaataatgggcagggcatggtggctcaagcctgtaatcccagtactttgggaggccgaggcaggtggatcacctgagctcaggagttcgagaccagcctcgccaacgtgatgaaaccccgtctctactaaaaatacaaaaaaaattagctgggcgtggtggtgtgcgcctgtaatcccagctacttgggaagctgaggcagaagaatctcttgaaccctgggggcggaggttgcagtgagccaagatcatgccactgcactccagcctgggtgataagagcaagactctgtctaaaaaaaaaaaaaacagcaaataacgttgtcctgtgccatgagccacatactcaaatatttacacaggtccaggggaagtaaagagtaaatatggccaccaggcgcggtggctcacgcctgtaatcccagcactttggcggctgaggcgggtggatcacgaggtcaggagatcgagaccatcctggctaacacggtgaaaccccgtctctactaaaaaatacaaaaaaattagccaggcgtggtggcgggcacctgtagtcccagctacttgggaagctgaggcaggagaatggtgtgaacccgggaggcggagcttgcagtgagccgagataatgccactgcactctagcctgggcgacagggtgagactgtctcaaaaaaaaaaaaaaaagagtaaatatggcctgatgtgaaaaaaaattataaccaccagaatttcctaaaatgtattttattgatctatagtgttattgcacaacatccacaaatatctatgatgacaattgtttaaaattcaagttaaaatacaaaatttaaaaaagtttacctacttttacgttgttaatttatgactctttgggtttgaaatgagatttgatgtcattgtatttatagatattccttgacttcttgtgttatgtaccaataagcacattgttaagttgaaaacatcataaataaaaaatgtgtagctgggccaggagctatggctcatgcctataatcccaacactttgggatgccgaggcaggaggatcacttgagctcaagagttcaagaccagcctgggcgacaaagcaagacccccatctccacaaaaaattaaaaaattagccagttgtggtgctgcatgcctggggtcccagctacttgggaggctgaggcaggaggatcatttgaacccaggatgtcgaggctgaagtgagctatgacggtgtcactatgctccagtctgggtaacataatgagaccttatttttaaaagaacacacaatgagtagctgagtagggctgcggctcactgccactgccagtgtttgaagaacagttcccactgaatgcatctcaattttgcactgtaatcaagtagaaaaactgtaagtccaatcattgtaagtctgggaccatcttgtccatagtcttatgacagaatactgtttaaaagtgtagatctatccgaatgttgatgaatttattgtgaaatgcttccccttgtgttgcttctatgtgatctatgtgcagcagtggacattttttttttaagtgaaaaacaaatcatgcccctcccttcattctctcccccgtgatgtttcccttagagaacattcctcccttcccttcccagtccccacctcagagatggggcaactcctccctttttatcacacttcttccactctgaggctctaggcaatcagttctcggtcactcccacccatgtgaaggtttttttttttttttttttttttgagttggagtctcgctctgtcgcctaggctggagtgcagtggtgcaatctcggctcactgcaagctccgcctcccgggttcacgccattctcctgcctcagcctcccgagtagctaggactacaggcacctgccaccacgcctggctaatttttttgtatttttagtagagatggggtttcaccatgttagccaggatggtctcgatctcctgacctcgtgatccgcctgccttggcctcccaaagtgctgggattataggcgtgagccatcgcgcctggccccgtatgaaggtttttgatgatgcttgctagaatggacccagataattttcgtgtggacagaaggtagatttttagtagctcttgttagaggtcatgtaggagattgtctcagcttgagctgctattgcaaataccgatactgtagactgggtggcttgaaaacaccagaaatgcattcctcagagttgtggaggctggatgtccaagataggacaggtctgagatcagggtgccagcatgcttcagttctggtaggaatcctcttccaggctacagactgccaacttctcgtgtcttcgtgtggcagaaaaagggctaaaaagatctctgggattttttttttttttttttgagacagagtctcactctgttgcccaggctggagtgtagtggtgtgagtggcatgatcttggtatactgcagtctccacctcccgggttcaggcaattttcgtgtctcagcctcccgagtagctgggactataggcgtgtgtgaccatgcccgactaattttggtatttttagtagagactgggtttcaccatgtttgccaggctggtcttgaactcttggcctgaagtcatgtgtctgccttggcctcccaaagtgctggggttgcaggcacgagccaccgtgcccagcagggcctcttttgtaaaggcactaatcccattcgtgaggttctgccctcatgacctaattacctcctacaggtcccatgtctgagcaccatcacactggcatttaggatttcagcttatgaattttgggaggacacaaacattcagttcataacagcattgtgttgtcacccacttttttttttttggtaggaacagtgtgtcgaactctggtctcaagtgatcctgctgcgtcagcctcccaaagctttgggattacaggcacgcactgccaaggccagccacatccatattcttaatctccaccatggcctcatgagcctggtcccctgtcagtgggctagggcctcgacatgggtaatacgcatattagctgaggttcaggaacccaactgacttgtgtaagaatttccagctggccccgcagaacaagaggctaaagagtggggagcagtgctagtgttgccactgctacagctctcgggcagtattcactaccctcatcctgtatgtgtgcccaggtgctgggtgagcatttcactccacacgagaggcatcatgcattccttcattcgttcgttcatgccgttatactatagtgaacaataaactcttgaggaatgtcgggtttaggggagccagtcccctgttcagttgaaaatctgcctggctatgtataaattttgactcccccaaaacttaactactaatagcctgctgttgactcgaagccttactgatgatatcaacagtcaattaacacatactttgaattttatacgtattatgtactgtatgcatttttttttctttgagatggagtctcactttgtggccctggttggagtgcagtggcaccatctctgctcactgcaacctcccagatttaagtgattctcctgcctcagcctcccaagtagctgggattacaggcatgtgccaccaagcctggttaatttttgtatttttagtagagatggggtttcaccatgttggccaggctagtctcaaactcctgacctcaagtgatccacctgcttcggcctcccaaagtgctgggattacaggcgtgagccactgcacccttcctgtactgtattcttataataaagtaagctagagaaaagaaaacgttattaagataatcttaaggaagataaaatctatttactattcattaggtagaaacagatggattatcctacaggaggaggaggaagaggagggggttggttttacagtctcaggggcgaaagaggcataagaaaatctgcaaataagtggacccacgaagttcaaattcctgttgttcacagttagtggtacacaggagacactaggtaagctaaaggttgggctgggcatggtggctcacacctgtaatctcagcactgtgggaggtcaaggcgggaggatcgcttgaggccaggagtttgagaccagcctggccaacatggtgaaatgctgtctctactaaaaatacaaaaagtagctgggcattgtggcatgtgcctgtaatcccagctacttgggaggctgaggcacaagaatcacttgaacctggaaggcagaggttgcagtgagccaaaatagtgccacttcactccagcctgggtgacagagtgagactgtctcaaaaaaaaacaaacaaaccaaaaagattagctaaaggttgaactttcagtgatgaactaaacagaaacaatctcatagagattgtggacaggagaagaaacaagcacaggtgcagttaaaacccgtgataaatgccccggcagaaacaagtgttaggccaggcgtgatggctcatgtctgtaatcccaacactgtgggaggccaagacaggaggactgcttgaggccgggggtttcaagcctgcagtgagctatgattacaccactgctctcctgcctgggcggtagagaccctgcttaaggaaaaaaaaaagaaaggctgggcgccgtggctcacgcctgtaatcccagcactttgggaggccgaggtgggcggattacgaggtcaggagatcgagacgatcctggctaacacagtgaaaccccgtctctactaaaaatacaaaaaaaattagcagggcgcggtggcaggcgcctgtagtcccagctactcgggaggctgaagcaggagaatggcgtgaacttgggaggtggagcttgcagtgagctgagattgcgccactgcactccagcctcggcgacagagcaagactctgtctcaaaaaacgaacaaacaaaaaaacaaaacaaaacaaaacaaaaacctaaaccaaaaccaaaacgcagcatagtccatgagagaggaagagcagggcaggcctactcacctggggctgtcggggaggctgcccaggaagggactctgaagtgagcacctggaggaaggaggttagttctgagggactggaattcatcctggcattgggatcacgggcaaaggtcctgtggtgacaaggagactggtgcgagcctggcttagcaccatgtgagagcagaggggtggaaaggcactaggtaagcatgccttcggatgtgaaatgagggagacggggactgggggaccctgacatgagggaggaggaaaggagatgggaagaatgggtgaccagagggaccactagaccaccgagggtgagagcttgctaatatcagagccatgtgtaggagaatgaagtgcaatcttggatagacctccagtgcaggtggtccagccatcaatgaccataaccacatgcatgattgtaggtggaaccagaagaaccacccaggcaactcacagaactggggaactaatcaagtcttgttttaaatgactacattacgggtggtttgccacgtagcagtggatcgctgaaacagtttaaaatatctattcagccgggcgtgcggtgggtagctcacacctgtaatcccagcattttaggaagctgaggcaggaggatctctcgaacgcaggaatttgagaccagccttgagcaaaatggcaagaccctgtctccacaaaaagtaaaaaaaattagctgggtgtggtagcatgtgcttgtagtcccagctacttgggaggctgggacaggagaattgtttgagcccaggagttcggaggctgcagtgagctgtgactgcaccgctacactccagcctggacaacagagtgaaaccttgtctctaaaaaaaaaaaaaaaatctacaaaccaggcaggagcactgaatagctcctgtctcccctgagacccttgtagaccttgaggtctgttacagagctcaccaaccttctcttggtctagaattatctaaaaagagttgagtgcagccagaaaggactgaatacatggtgttcttcaatcccatcaaactgctgtgccctgcagatgatccctgagtccaggtgttggtgggttgaggacaaggctgagggaacagaggtgggaacagtggcccaggaccaggagaatgcagagttcagagtgcatgacctgcatctaactctagatgctccaggggtctgagaccatctccagcagggtctggaaggcccagtcattccccagcacgcacagtcaccactggatactatcttgctctgtgagtgatgcaaaggtcctgggtcagtgaagcctgtgaaacaaagttgggaccagagtgtctctacggttgagggctgggcttatttgctctctaagtataattgtaagagcaaatagaaacacctatcctctctgagcttaaaaggatcaaaaagctctgacagtgtcagtggtagggctagttcaggggctgcagtagtgctggtgcccacaggtggaaccttctcctgccctgattcccaaggactggtgctctcggaggggtctgggaggtatatttctctttcacaaatacgtgcacaacacatgaatgagctactggatgagggaataaatgaatgaatgagtgaaaaaagcttcctttctcctctccaggagttagcaatcactggttagttccccactgcccaccagcctgtgcagaggagggaggagcaacaggtcatagatgtggttgcagctgttactggacagagtggtcaagacatcctgtgtctgcagaggccctccccagccctcacctggacagtggagctgttggccagagaggcagtgggaagaagggtggggctcccagagtcgacccagcgggctgaaactggtgcagtctgcgcctcaccaggcagagaatggatgtggggcagcttgacaccgagcaggggctcatctgagcctcaggggtggttgctctatcaaagtgtttgcaagtaaacagtcccagtgcacacccagctgctcagtgccacctcgtgcacccagggccacttcagccttgatcacaggcctgcacaggttccaggggaggagacactccagctttttgagggagggtgagcatgtgggatcagagactttaagtccaaatttccccttaatttttttttaaatcttgcaggtagtatgcaaacatacatttaatgtattatttttattctcatttatttttttgaggcagggtctccctctgttggccaggctggagggcagtggcgagatcttggcttgctgcagcctcaactcaacctcccaagctcaagtgattttcccacctcagcctcccaagtagttgggactgcaggtgcctgtccgccatgaccagctaatttttaaattttttttgtagagatggggttttgccatgttgctcaggctagactcgaactcctgagctcaagtgatcctcccaccttggcctcccaaagtgctgggattataggtgtgagacactgcatccggctcccaaatttcccctttttataaggacaccagttgtactgaccggggccccacctctatgacctcatctaaccttcattaactccttaaaggccctatctccaaatacaggcacactgggggttagggcttcaacctatggatttgggggatgcaattcagtctatcacagtgccaagctgcacctgctcggtgagccagaacaggggtggggaaggcaccaggccctggtgcttctttcccatgcctgagtcactctacttggttctaggagggagaggagcatgggctgaaggcagtgctgcaacatggaaggggcagaacatcccaacccgctctgggcccccagtgtcttctgctgtacaaagcaggtgttttcaccccccgaggatgtgtcctcccttcctggctcaccaagcatttaaatgtagacagaaaatttatttatctggggtgcggtttcctcagggggaagttgaggtcacgacccctgaggtaccttaacccaaaggcctccagggcactggccccagagtctccagcaggtgcttcctccctgaatgcttccatatggcaagatcagagccacaaatgctgccccgacactgttccggtaaccgacgttgcagacccaagaaagtctgggatggtagtggccaggaacggggtgtgccacggccccacctctcagagcagggaggaggatgctgggccagcccttggggaccccaggcaccgtggccacaggagtcagagctctgcatgtctgcaccatgtcctgggctcctgtcctgctcatgctgtttgtctactgcacaggtgagggaacccccagatcccaaagactcctgccccttccttcatcctgccctgcccccacggcccacatgcatctgtgtcaccaggttgtggtcctcagccggtgctgcatcagccgccggccatgtcctcggcccttggaaccacaatccgcctcacctgcaccctgaggaacgaccatgacatcggtgtgtacagcgtctactggtaccagcagaggccgggccaccctcccaggttcctgctgagatatttctcacaatcagacaagagccagggcccccaggtcccccctcgcttctctggatccaaagatgtggccaggaacagggggtatttgagcatctctgagctgcagcctgaggacgaggctatgtattactgtgctatgggggcccgcagctcggagaaggaggagagggagagggagtgggaggaagaaatggaacccactgcagccaggacacgtgtcccttgaactgaagacagcagaggcacgcatccccttggagagactgtcatggaagagggtggagccgccgcccgaagcgccgaggaggctgagccactcagcatctcctggtcctgcagtgttgctgtaaatccccattggagactgcattagggaattaaagctgcttgtcactttttgctgagtttggtctgactgttgtgcgacttcgtagtaccagccttgggcaaaggcccggggccccgggagactggcagatcactgtggtgagcactcacctgagtccttacttttgtgggccatgggaggcaaggggttgaccgaagcaccctggaggggcatccatgcccaggacaggaccctctggtgtcatctgattctgcccagcggttacagggcaaacaagcttagaaagcacctggtctgggcctccagggagaacaggagccaggtaataggcctagagtgggttctccaccttggtcctatcgacgttttgggctggacagttcttggttgtggggctgtcctgcggattgttgaatggtgagtggttatctgtggcctctacccaccagatgccccttcccagttgtgacaaacaaaaatgtctccagacattgccaaatgtccccaggtggtaaactcacactgattgtgaaccactggtctagatgagcaagtaaatgcatttacttatttgtacaagagagtggcaggtgtcggcaaacatgttctttttttcctttttttagggataaagtcttgctctgtggtccaggctggagtgcagtggtgcaatcatagctcaccgcagcttcaaactcccaggctcaagtgattgtcctgtctcagcctcctgagcagctgagactacaggcgtgcatcaccatgcttggctatttatttagttttatttttggagagatgaatgtctcactatgttgctcaagctgatctcaaactcctgagctcgagtgatccccctgcttgggcctcctaaagtgctgggattagaggcgtgagccactgcacccagcccattttctataaagagccaggtggtaaatatttttggctttgtgggctatgcgatctctgtcacaactgttcaattctgtcctagtagcaagaaagcagccacagacaaacatgtcaacaaagaggcgtggctgtgttcttataaagctgtatttacagaaacagatggggctacactgggctgggtatggcgcccaggctgtagtttgctgagccctgctcgggagcactccagctcctgtctccaggttttaagcaagccatgcttggtgggataatcagagtcccccctcaacttatcttgcctgtgaccccaggcagaagcctctggacccatggagatacctagaggcatgaaggacgtggtctcactgagactgtgttggactgtctgggtgaagtagcaatggggagctccctgcagccccggcccacagcaaggccccctgagcccgtgggtggtgggtctgagtgtgccttgcagagagggactctctacactgggtgtccacacaacctgtagacatgcctcactcagagaggtgccgggcaaaccatctcccttgtaaccccaacttgcctgggaacgtgcattcaccccagctaaaaagatcctgaggcatctccccagagaggtggacacatgtcagtatcagcgttccatgtgtggtcatgagtccctctcttgttaaacagtggtctccagcactttgggaggccgaggcgggtggatcacctgaggtcaggagttagagaccagcctacccaacatggtgaaatctcatctctactaaaaatacaaaaattagctgggtgtgttggcacatgcccgtaatcccagctacttgggaggctgaggcaggagaattgcttgaacccaggaggcagaggttgcagtgagccgagatcatgccactgcactccagcctgggtgacagagcgagactccatctcacaaaaaaaaaaaaaaaaaaaaaagagacagtgatctcagcttatgccatactctatgcactgggttcttcctgcgtcaggcttttacccctgggccaggcccacattttaaaacattattatttacttgtttattattttattttagagataggatcttgctatgctgcccaggctggactgctgtggctattcacaggttcaattcatgatgctctacagccttgaactcctgggctccagcgatcctcctgtctcagcctgctgagtggctgaactacacgtgtgagtcactgcacctggccatggcccacagttttaaagaccagctagatggttccagaggaactctgtcttctgcttgtaacccgtccctctcttgcctccatccttcatgattctgggattccatgctatgagaagagatctagaaagccgggagctgagttggactcctgtatcatcctcatgcccccaccccaccagctcaatggaaaatgagacctggaactcaggcttgaggccagactgagtgtgagtcttagctctggaggagtcacttaaaatctaagccaacatttccaatgttgcatgtaaaggggataatcatagaactgattaacttatataaaaagtttttatctggccaggcgtggtggctcatgcctgtaatcccagcactttgggaggccgaggcgggcagatcacctaaggtcaggagtttgaggccatcctgggcaacatggtgaaaccccgtctctaccaaaaatacaaaaattagctgggcatggtggcgggtgcctctgatcccagctacttgggaggctaaggcagaagaattgcttgaacctgggaggcggaggttgtagtgaaccgaaatcgcaccacatcactccagcctgggtgacagagcaagactgtctctcaaaaacaaacaaacaaacaaacaaaaaggttttatccatcatgagtgctcaacaaaataatagtatcatgatttccccatcagtcacctgcctggccttccctgttgtcaaatcctttcctttagtctgagtcatttctcaccttgaccattatctggtctccttcccatccatcctcctgctgcatgcagtctatacccaccactcctcatctttgttgctcctagatccagccttgcatgcattcctcctctctaaccctttattgtctcccacactctaaagaacatatgcaagccacatctgtaatttccaattttctagtggctacattatttttaaacagtaaaaacaaatagatgaaatgattttttaatgatatattctatttaacataataaatccccaatattaccaattcaacctataatcaatataaaaattagttactagatagtttaaacttgtttttcttttgtattcacacttcaaaatctggtatgtattttatattcatgtcttggataatttgctcaagtggataatctggtcagccaagtggtcaagagctacatatgccttgtgaagagaccactttggttgaggggatgcaattcagcctccttcccatgacacagcctttgaaggctggctcaggcttggtcccaagtcccatttcttgtgcaccctctctccctgtttctgccatgttaagccaactgcaactgatcaaacacccgagtctcttggttgcttctaaacctttgcccaagctgtttactgccaggacttcctgtccctttgttgtggcctccatctggctgcactgactcggggctccacaactgtctcaaatctcactccttgggcaagacttccccgagctcttcatgcagttattaacttcctccactgtgcaaacagcatgttttcctaactatatttagcttctactgcacagttataaatttatttagcaaagctccctcccctactaatctgcagattctcagtgggcaggatctactcaacccattgatgtgcctgataaacacttggcaattagacagttgaatgaacaaatgaatgaatgtgtaactgaatgaattttcgggttccaaggaccctgacattctgggatcccattaggtggctggggtcaccaccttagagaattgtgattccctaagaagggagaaccagcccagaccttctcgatcatattagtgactggccacatttcctctcctttctgattctctctctcccccacacccttactgcatgacagtgatgagaaaatccacttgatcaaccaaactacaactttcggcctcatccctatccctcccttgccttctgaccagggccacagtcaccctgtgggttcttccttttgagtgtctctcactcccttcctcctccatatctctgagaccagcctccagccctgctggcctgctctgctgccttctggctctttgttgaacccaagaccagggtttatatatgttaaatataaatatatttttccatatgaaatgtaaacatattttaaacattaaatataaatatacatcttagatatggcctgtgttggaatgtgtaatagattgagtatataatgtctattcaatataaaatttatatttatatatgcagtaatgattcaggttgattgtagttaagaaaaacaagctccaaattcgagagaaatatgtaagaagagagacaggaagaaaaaataatgaggcaggtaaatgcaacagacaattcgagacccacaagtgcagagcaggcttcccagacccggataatgtctcctgggctgataggaagccctcaaccccccaagtccttctcagccataaaccgcctgagcacagagccacagggaccgtgttggggctgggcctctcgactttagttcctctcattctgtgcaaaaggaaaaacaattcagaatctacagaggtttagatgtgtgtagatgtggacagagaagtcctggcacggtggttcactgcccaagaagacagtgagtccctggagggatagaagaatatacatcatgctaatatatgtcatcccagtactttgggaggccgaggcgggtggatcacttgaggtcaagagttcgagaccagcctggccaacatggtgaatccccgtctctactaaaaatacagaaattagttggctgtgggggtcgatgcctgtgatcccagatactcgggagacagaggcaggacgaactgcttgaacctgggaggaggaggttgcagtgagctgagatcatgccattgtactccagcctgggggacagagcaagatcccatctcaaagaaaaaagaaaaagaagttgtgagtgctaagttctctctggattttcaggaggccagttctccagtccacagtggcctgggaggacaggggttcctgagggtgaacagagcctgtgcccggtcaggtaggatcgcatgtccctgaggttcagaacccaggagcatggggagggtccagggggttcctgctgcatggagggaagaccctctttccacaggggccccggagagcgagaggaaggaggagggcaggtcagtgagtgtgacggggtcacagtggagagggaagcagaaagaagtgtccccacaacaagacacacacagtgtctacgctgaagctacagagagggcctctccacctgtgtctgccgcaaagcagtggggcgtcttctggcagcccagagtcacctccagatcccacctgcaccatgcttcctgcagggactgcctgtcttcctaatacactgtcttctgaccagagtcttccagacaaatcactggttgctatatatatatatatatatatttttaatagctaatatcttacactgatatatttatattatatataaatatttttgtactttatgtttaggctatattacagatgtagttagttagctatttatgttatatataatataaacatgatgtagattcttatatttctctggggactcactgtcttcttaatacactgtcttctgaccaaattcttccagacaaatcagctgttgctatatatatatatatatgtgctatatatatatgtgctatatatatatgtgctatatattttattgcatagaatatattatatattaattatataatatacattatacattacatattatatataatatattatattattatgctatatcttatatattatatatgttatatatgtatatatattatatatacacatacatacactcatgtatattttaatagctaatatcttacactggtatatttatattacatatgtttatatacaaatatttttgtactttatgtttatgctatatatacagatgtaattagttgtttatgttatatgtaatataaacatgatgtatattcttattttcctgtgaggacccactgtcttcttaatacactgtcttctgaccaatgtcttccacacaaatcagctgttactatatatatatataatatttatatacacatatacacatacatacacacatatgtatattttaatagctaatatcttacactgatatatttatattacatatagttatatactaatatttttgtactttatgtttatactatatatacagatgtcgttaggtatttatgttatatataatatattaacatgatgtatattcttatattcttctggggactcactgtcttcttaatacactgtcttctgaccagaatattccagacaaatcactggttgctatatatatatttttaatagctaatatcttacactgatgtatttatattacatatagttatatacaaatatttttgtacttttgtttatactatatatacagatgtagttagctatttatgttatatataatatatcaacatgatgtatattcttatattcctctggggactcacagtcttcttaatacactgtcttctgaccaaactcttccagacaaatcagctgttgcaatatatatatatatatatatatttattttttaatagctagtatcttacactgtggctcatgcctgtaatcccagcactttgggagaccaaggcaggtggatcacctgaggtcaggagtttgagaccatcctggctaacacagtgaaactgcatctctactaaaaatacaaaaattgattgggtgtggtggtgcatgcctgtaatcccagctactcgggaggctgaggcaggagaatcgcttgaacccaggaggcagacgttgcagtgagccaagatcgtgtcgctgcactccagcctgggcaacagagtgagactccatctcacacacacaaaacatcttacactgatgtatttacattacgtgtagctgtatataaatatttttgtacttacattctgtgtacttatattctatatattataaaacattatataaaattatacatgtataataaaatgttacataaaaattttaatataataccattttactacatatatttctaaatttaatataatgaaattttatatataataatgtataacatttctaaacttattataatacaatgatatataattattttctcatattataattatacataaggtaatttattgtaaataaaattttatataatctacgtttattataataaaattttattacatataacacatttctaaatttaatacaataaaatactatgtataataatttataacatttcaaaatttattatataattttattatacaattattttatacataattatatatagtatataattgtatttatagaaatataattatgcatatacaatatgtaattttatttttacatagtatatatacataattatgtattaacaaatataataatatcaatttatatacttatttacattaagttatatattatataaatgatgttatatgttatatgttacatatatttttgcttaatatattaaatttaatctataaaattatgtattacaaataaaagtgtattttacatatacactacatataactttatttatataaaaatataaaagtcatatggttaagttaataaaatatatttatatcaatctattcatataaaatatacacaatgcatatttatataaatacaaagtatataaaacttttaccagtaggatgcaaagagttgctgaccgtctgcagaaatcctgaacctctggaagcagaataaaatcttacctcccagtctgctttgaaaggaacagtaaagcagtcccgaaccccaaacccatcctaaggggagatgggggagttgggatggacgcgttgaccagtgaggactttcctttgctggttttgaggtgtcttagcccagaagctaagacgggaagtgattctggagcaggtgagctgatcacaagcctgagccaagaatccatggagctcataaatagcagaagccgggaccctgtgcaaatccttctgaaatatcccccgtttactgggctcctaggggtggggaagaaaaattccctgacatttcggcctcagggaaagagagagagaccccactggccggaagcctctgctatttttcagaagacagctggggcatcactctttcccaaatgacggtgattttcagagtggttcactttttggagagacatttctgccctggagatccatacatattgaacccaaacgaatattttttaattaaaaaaaattaaacattagaaagttcaatattgaggcagctacgagtttgaattcctcatttttcctagatgcatgttgtcaaaatctgtattgcatttagtaactacttatgtgtctaatgtatataaggttacacaatgtttttttctgctcctcagggtcagaatttgaaataaaagttttggaaagaaaaaacactcttgtctgtttgtgcaaaaataaaagaacccatattttaagaatattttaaaataaatacaaattttgtgtgggagggttgcttataagaattcttcatatcctaaatcaaagacagatcttgttattaaccagaaaacaaaatgtgtgtgtataaatgtacaacactcttacactcacacaaacacaggcacacacacacattcacgcactcactgatgtactcacacaaacacaggcattcatgtataaatacacacataagcgtgtatttatagaaatataattacacacatacaatatataattttatttttacatagtatatacacatcattatgtattaacaaatataataagatcaattttattatatacttatttacataaagttatatattatataaatgatgttatatggcatgtatatatcacatataactttgcttagtatataaaatttaatctataaaattatgtattacaaataaaagtatattttacatataaactatatataactttatttatatgaactataaaaatcatatgtttataataaaatatatttatttatatcaatatattaatataaagtatacacaatgtatatttatacaaaaatttttaattaaaaaatattcatttgggttcaatatgtatggatcgccagggcagaaacgtctcttcaaaaggtgagccgttctcaaaatcaccgtcacttgggaaagagtgatgccccacctgttttctgagaaacagcagaggccagtggggtgtctctctctttctctgaggccgaaatgtcagggaatttttcttccccaccactaggagctctgtaaaccggggatatttcagaaggatttgcacagggtcccggcttctgttgtaaatgagctccatggattctcggctcaggcttgtgatcagctcacctgctccagaatcactgacacaaatgcaaccacacacttacacaaacacacatcaacaccaagacagacagaagcacaaaacacactcatagaaacacatggacacacaaagacatgcacactcacacaaacgcagggacacacacacaaacacaattacaaaaatgtggggtttttttgcacacgtgggtgcacatgcacattgacatgctcacaaagcacacaaacacgtatacatacaaagacactcataaacagaatcatgaaaacactctcatataaacacgtggatggctactcacccacatagacactcacatatgtcacacgcactcatacacacactcagaatcacacaagcacacacaaacacacaaatacagtcacacactcatgcaaacacagtcacaaaaagactcacataatcatgtggacacacaaacataaaaattcacacactggggccgggcaaggtggctcacgcctgtactcccagaactttgggaggccgaggcgggcagataacttgaggtcgggagttccagaccagcctggccaacatggtgaaaccccgtctctactcaaaaatacaaaaattagccagatgtggtggcgtatacctgtaatcccagctactcaggaggctgaggcaggagaatcatttgaacccgggaggcagaggttgcagtgagccaagatcacgccactgcactccagcctgggcgacagagcgagactccgtatcaaaaaagaaaaattagccagatgtggtggtgggtgcctgtaatcccagttactcaggaggctgaggcagaagaatcttttgaacctgggaggcggaggttgctttgagctgagattgtgcctttgcactccagtatgggtgacagagcgagactccatctcaaaaaaacaaaaaaaaagaatttatacattgccatacagattcacagacatacactcatattcacaaacacacaaatacgataaacgcaggggcacacacaaacaccatcacaaaaacacacttccataaaacacaggaatgcacgctcacacagaaacacgcatggaaacacacgttatcttacagattcacagacacactcatcatcacataaacaggcacacacacacagccacacaagcacacacccacacccacatcaacacacacactcccacacggcacccacgcgctcacgcacataggtagaacaggcctgcattacctgataacgcagttagatcagacgtgatgctgcctgccgaggagacctggaggcttcccatgaatgggctttcggatgagaggtctctgggtgcatttggtgacaccccaggcagtgggggagacgtccaggctggaaggccagccacagccagctctgcccaaggatgccacgtccatttgcttcagtaggatatgcaccctggaaacccaggttcctgcctctccaggaaaccccactgaggtcagcacatcccccaaggtttagaaggggtctctgggtgcatttggtgacaccccaggcagtgggggggacatccagcctggaaggccagccacagccagctctgcccatggatgccacgtccagttgcttcagtaggatctgcatcctgtaaaccctggttcctgcctctccaggacacgccattaaggtaagcacactccccaggtttagaaggggtctctcggtgaaatgtggtgacaccccaggcagaaggggggacgccacagccagttctgcccacggatgtcacgtccatttgcttcagtaggatctgcaccttggaaacccaggttcctgcctctccaggacaccccactgacgttaacacaccctccaggtttacaagcggtctctgggtacatttggtgacaccgcaggcagaggggggacgccacagccagctctgcccgcggatgccgcgtccatttgcttcagtaggatctgcaccctgtaaaccctggttcctccctctctaggacaccccactgaggtcagcagcccccaccccccacccccaggtttgtccagcttcgctgtctggggagagacacagaaagaccacattcggtggaattctggctataaccttttgtagccggcaagaaggatcaccaagctgtcccgttaccttgctggagcgatcactggtttcacgcttggcccccgtgcagttagtgcctgggccaggctcgattcctggagctcaggtgaaatttgggcttggagctcacgcctgcaccatccagaaagcagaaggcagccggcccgggctgtacggttcgtagaatcagagagaacactgcttgccttcatgtctgtaccacaataaatctgccaactgcggtcaaagtctctggattcctgccccctcattttattttgtctattacggagtggaaggagtgagaaagattttgcttcctattttgttttgcaaagcgcttctaagaaaaacaacccgtgttctgaaaacgagattctgagtgtcccctgggcgcgatgaaaacaaactttgggaatccaagggcctgagaggcagagtgaatgtcatttgcatttccctgcgaatgacaaagtcactttttatttattattattattatagattcaggggatccacgggcagctttgtgacctggggatattgtatgatgctgaggtttggggtatgaatcatcccgtcacccaggcactgagcattgtacattcctgaggtatataatgtgtactaaaaataaaatgtatatttatatatgcactaatgattcaacttgattcctcgtaattaagaaaaacaaaccccaaattctagaggagttctagaaatatataagaagagggccaggcgcagtggctcatgcctgtaatcctagcactttgggaggccgaggcagacagatcacctgaggtcaggagttcgagaccagcctggccaacatggtgaaaccccgtctctgctaaaaatacaaaaattagccaggcgtggtggcaagtgcctgtagtcccagctacttgggaggctgaggtagaagaattgcttgaatccaggaggcagaagttgcagggagccgagactgcaccactgcactccagcctgggtcacagagcgagactccatctcaaaaaaaaaaaaaaaaaaaaaaaaaaaaaaaaaaaaagagagagagagaaaacaaacaagcaagaaaatgcaacagaaaaatccgtgacccaaagctctctccagttgctgctttctgccggaaattcaaagaacctcagggtagtttttcaacccttgtacccccgcccctgcttcctgctctattagtcctgagggtctgtggtgccgctccatcatgtccaggtgcaggcaatgtttagctcccacctataagcgagaacatgtggtatttgattttctgttcctggcattaattcactaagcatagtgccctttggcttcatccatgttgatgcaaagggcatgattttattcttgttcatggctctgtagtattccatgatgcggaaggaccacatttgttttatctaattgagaacatgtggtatttgattttctgtttctggcattaattctctaaacataatgcccttcggcttcatccatgttgatgcaaagggcgtgattttattcttgttcatggctgtgtagtattccatgatgtggaaggaccacattttctttatctagtggagaacatgcggtatttgattttctgttcctcgtattgattcactaagcataatgccctctggctgcatccatgtggctgcaaagacatgattttatttttttcatcactgtgtagtattccgtggtgtaggagggccacatttgctttatccagttgagaacatgtagtatttcattttctgttcctggcattaattcactacgcataatgtccttcagctgcatccatgtggctgcaaaggacatgatattattctttttcatggctgtgtagtattccatgatgcagaaagaccacatttgctttatctagtggagaacatgtggtattcgattttcttttcctggcgttaattcactaagcataattcccttcagctgtgtccatgtggctgcaaagatgtgattttattctttttcatggctgtgcagtattccatggcatagaagggccacaattgctttatccagtcaagaacatgtggtatttgattttctgttcttgtgttaattcattaagcataatgccctccagctacatccatgtggctgcaaaggacatgattttattctttttcatggctgtgtagtattcgatgctgtagaagaaccacttttgctttatccggtaccccactgatgggcaactaggttgattccatgactttcctattgtaagtcgtgctgtgatgaaccttacagggctgggcactgtaatcccagcactctggagggccgaggtgggcagatcacctgaggtcaggagttcgagaccagcctggtcaacatggtgaaaccccatctctactaaaaatacaaaaattagccaggcatggtggcgcatgcctgtaatcccagctgctcaggaggctgaggcaggagaatcacttgaaccaggaggcggaggttgcagtgagccgagattgcgactgcactccagcatgggcaatagagcgagactccgtctcaaaaaacaaaaacaaacaaacaaaaaaaaaaaggaagtttaccatgcatgtgtctttttggtagaatgacttcttttcctttgggtagatgcccagtcttggaattgctggcgcaaatggtggagcagtttagattcaggaggtacatgtacaggtttcttacatgggtacgatgtgtgatgctgaggtctggggtatgagtgatcccatcacccaagtagtgagcataataccccacagttggttttttcaactcttgtccttctaccttcctctctccccctaactagaccccagtatctcttcccttctctgtgtctacgtatacacaacatttagctcccacttataagtgagaacacgcagcattctgttaatttacttaagataatggcctccacactgttcacaatagcaaagatgtggaaccaacccaaatgctcatcagtgatagattggataaagaaaatgtagcacatagacactgtggaatactatgcagccatgaaaaaggatgagttcatgtcctttgcagggacatggatgaagctggaaaccctcatgttcagcaaagtgacacaggaacagaaaaccaaacactgcatgttctcactcataagtgggaagtgaacaatgagaacacatcgacccagagaggggaacatcacacactggggcctgttgcaggagggggggactggaggagggacagcattatgagaaatatctaatgtagatgatgggttgataggtgcagcaaaccgctatggcacatgtatatctatgtaacaaccctgcatgttctgcacatataccccagaacttaaagtagaatagaaaaaataaaaaataataaaaataattaaaaaagataatggcctccagctacatccgtgttgctgaaaaaaaaaaacaccaaaaacatgattttgttccttttcagggttgtgtagtattccatggtgtagatgtacggcattttctcgagggtggagggtgggaggagggagaagatcagcaaaaacaacctgtggctgggtgtggcagctcacacctgtattctcagcactttgggaggctgaggtgggtggatcacctgaggtcaggagtttgagatcagcctggccaacatggcaaaactctatctctactaaaagtacaaaaattagacaggcacggtggtgcacgcctgtaatcctggctcctctgtaggttgaggcaggaaaatctcttgaacccaagaggcggacattgcagtgagccgagatcatgccactgccctccagcctgggccacagagtgggactccatctcaaaaaataatcataaaaataataataataacctgctaggcttaggacctaggttgattccattacaaaaaaaaaagaaaaaagaaaaaactaactttttaaaagaaggatctccctgttcaaaaacaaaaccaatgccctgtcaggaaagatgttctgtgtttctggtaaagctggaaggaacctacaggaaggagtcaccccataaaactagtggagcagcattgccttttggggtgagggctgcttctgttaggccaccaggatgagtaccttcctggggagtgtggttcatcctataccatccaggaagcaattcctgcccccaaatcacccgccagcttctgccctgtaagtaaaatccccagcaagcgggcagcaaggagctacttgccttggaaggcagccgaagtctctgtccaccacccagactgtgtcctctgggcaaggccagggcttccaattggatggttttcacattagcggctgctgtttagaatcatcaacattggccaggcgcggtggctcacgcctgtcatctcagcactttgggaagctgaggcgggcggatcacaaggtcagggaccagcctggccaacatggtgaaaccctgtctcaactaaaaaaaaaatacaaaaattagcttggtgtggctgggcatggtggctcatccctgtaatcccagcactttgggaggccgaggcgggcggatcatgaggtcaggagatcaacaccatcctggctaacacggtgaaaccccgtctctactaaaaatacaaaaaattagccaggcacggtggcaggcacctgcagtcccagctactcgtgaggctgaggcaggagaatggcgtgaacctgagaggcagggtttgcagtgagcccagattgcaccactgcactccagcctgggtgatatagagtgagactctgtctcaaaaaaaataaaaaaataaaaaattagcctggtgtggtggtcggcacctgtaatcccagctactcaggaggctgaggcaggagaattgcttggaccccggaggcagaggttgcagtgagccgagatcgcgccattgcactccagcctagacaacagagcaagactctgttgcaaaaaaaaaaaaaaaaaaaaagaatcatcaacattgccttggcccaatctcttgtcaaatatttaccactggacctccatgttctagtttcaaagctctgctggccacagtggctcatgtctgtaatcccagcactttgggaggctgaggtaggaggactgcttgaacccaggagcatgaatccatcctaggcaacatagtgataatagtgtcaaatcagagccagtgtctggtaattccccaaatatctgagaattttcttttctttaagtcatagtcatcctggcagaaggctgtaggtccctttggggaagactgggaaaaagataaacaatgtaaatttttggcaatgtagcagcgtacttccccaagatcacccagcctccccttcacttaaggggttgtgggcctgtgaactggctcaagtctgggaattgattgagggttttagatctgtgtttcattaatttgagttagtcttttattcagttgacctagaattcttcattttttaaagaacaactaagactttggtacagcccattagctctccctgtggataccatggattacacaatgccgtgggtgtctgtgagtcaaaccattctgactgctgctttgacactgctttccactgtggtgaccacacccaccttatcttcggtgattaaggacagcccatgttccctgccaccctaggattcaattatcctcattttacttaaagatcccagtccagtggctgcagttcctgctgtaacattttgcctactgagagcacaagctcaaagctcttccaggatactgggctcctctcacaatattctttctcatgatcgtcgtgaggagtatgttctgtagaccctccagtgtgagtgagcaggtctgacataataaatccagtctccgtgagtttttgcatacctttctgtacacataaaccaaggaagttgtggcatctcaactttatgtaccttaggtaaactctgattctgtttcagccaaccaaccaagtcaccaaacaaataagcaaacagccaaccaatcaaccaacaagcaagcaacaaaccaaccaaacaaccaagcaaggaagcaagcaccaagcaagcaagcaaccaaccaaccaagtaaccgatcaaaccaacccttggagccctttctaaagctttgacttacaaccctgagtccagaatctctgtttagtgggccaacattaataaatgtagccgaatccaactttatgttacttccaccatggtgccactcacttaatatccattcccacgtatattctccagatttccttctgtataaattgcgtgtgtgtgtgtgcgggtgtatgtgtgtagaaagagagcatcaactgaaaaatcacaaaattttataaatttagaaaagagagctttatttcttataaaggtttgcagtccgcaaggtggccattatgacaggctgggaagtgtggcctacagccaaggccagaggcaggcatttccagggagggaaggagaggacaggaatttgagccaaatgagttggctacatatacatactcaataggatatcagaggagctacatcattttatgagaatactcataaaagaggtcctaacgcatgcatattcaataaacatgcatgttcattctggggtggagacttgacatttaaatgtattataattaggccctacacatcaaaaagtgaagcagggacataaaggtactcagcctctgtaaaggctcagcctctgtaaaggcacagcctctaaaactggccagaaccagtccatggaggatggtctcttatcaggagaaagttactgaaatcagtcccttgtccagagaaagctgtcgttaaggttagtggggcaggagatcagttactcagcgtctgtgaactgggtgagttgtaattgttttaatcttgcttctctcacagccagtgcttgcttggctgctagagaaaaataaaacccatgtggtagttagaatctagttaattctttaagagtagggtacaagacttaaccctcgcctggcatggccctaggccctgtttataatttgaggtcttattgccacaaagagtctgttctgtcagtctcatgatctctattttaacattaatgctgctcagttgttgggtctaaaccataagagggagggaggtacagggaggtatgtctgacctcctgtcctgtcatggccgagaactgaattttaagatttatttgaggttccgttggccaacagggggtctgttaagtcgggtggggggcttaggattttattttttgttctcaagggagataaaataatttaatccattggcctctgtgactgtgggactaacatggctatgatctgtcggacagacttcaggctggcacccaggcaaaattctatgctgtagtaaatgcatcatgcacatttgtaacaacacgtacataacaatgtcacaaaatactttcacggtgacaactagattagtgttttattgaatagctgatgacataaactgtctcatttggtgccaagactgaccatcaccagcataccaaggtcatcactgatcagaggtctaacccaaggagggggtcatgtgcaggcccagcggtggggaggaaagatgctgcagaggagatggatgcccacagaggcccctgagcggataccatgctcactaagtggtaagtatagactcaacgtaggctgtaagctctccccctgtgtaaatgggaccccgtacacttgagagtcaagggtctgtttgggtggcagggatagccacttctgaaggtagaaaggaaaataagccaccaaattggtacctttctgtgaaatggacatcgtgctcagaatctccattttccccacaacctggaggagtaagtactgtcatctgcattttgtagctgaggaatctgactcaacaaaattaaattactcgcctaagcaattagcaatcaaccaagtctttctgactcagaaacccagctattgcctgttcatatccagcccctgtattggggtcaagatctggcctgttctcaatgcagcaagatccaggcagatcacactggactcccagcactgaatctggctcgaggggacatcaaatttgactgggtcatggggctcaggagcatcactctcaaaaatagcagtacaggaagaggcaatggccctaaacagcatttgcaggcagatcccatgttaatcgtaagggtcaggactctctcacttttctgtctctctctctgtctctcctctagggctgaccccacatcggacaccactgcatccatgtccatcacaacacagctgccttttcttctgcctgcttatgggaaagtcccctcctctcctccgtttccttctcttcctgccctatcacactgtgcacttctccctttccttaaagaaccaccatcaactttaggaggagggaaaggggtggctctgggaggaaaagccagaatcccctctagccagcagagagagaggaatggctgcatgttttctcccccaatccaaggcactaggttttggctaggttgcaggttccaagctgctctcctgctgtgtcggtgagttctggttaacctgcaacctcctgatgtggccactgcagttcatcgagtcttcagggactccccatggcctggagtactttgccttgcttacatgggagaggagaatggatttatagagaacatcatctaaatccaacttgaccattgtgtggccacacttgctagattgctatagtctaaatctagcattgtagaaagacgggggagcttggagctgcacaaacccaggtctggaacgggctccttaccttggaaggtgaatgatcctggtaggactcttagcctccctgggcctcagtttctttatctgtttcatgggaatgaggatctcggctggttggttgggtgatgcgggggctgtgtgaaaacagcttgtcaatacaagctgaaatagaaatatttctccacagagtatgaagatcaaatgagagaatacatttaaattaaatggaaaattaaaatggcaaaaaaggcaaagctgtattgaaagttccgagcttctctataaggagctttttgactatgtaagaatcctgtactcgttccccctaaatataaaaaaaaaatgttgaaggaggcagaagggagagtgatgcacgatgggcgaggacttcacctgctgttgctggctttgaggatggaggaaggaggccacaaacctagaagctggagcccctagaagctagaaaaggcagggacccgattcatcccttgagcctccagaagggacatagccctgccagcaccttgactttagcccagtgagatcctcttaggacttttggcaaccagaactataagacagaaatggaagccactgagtctgtagctgtttgttgcagcagcaatagaaaactaatgcagagcccaagaaatcactggtgatgagatggggaagtgggctcaggaggtctggatctgtgatgagatggggaaagtgggctcaggaggtctggatctgtgatgagatgggggaagtgggctcaggaggtctggatctgagttggggatctggagtggaaggggaattcatttgttcattgtctatccttttgcattaattgaatttttttctatacatacatgtgaattttcacaataaaagttttttccaaaataaaataaaagaaacaaaaggggctttttgcaacccaattcctatctatgtctgagtccacttgtattgaatgagtctttctgctaacgtccttatatttgggtgactatctgaatgtcagtgaccaatcagagcagaggcagaccttggagtgggcagggcatcctgagggccctgattcctgccataaggcataaccctttaggtgccagaccatggggaggtccaggggttgcaggggagggctgtgcatctgcaatggctctcagggggctcccggtggtggcaattggtgaatctgcatggtggtgtttcagtattgtcacaaccctgctgtctctcatgctctcaaaaagcatttctcttacctgtgacagacttcctatacctaacagcttgcaaaaatgttccagattaatgagaataatctctcggagccatacctccctgcttggggtctcagtttccccaaatgtctccagacaagttaggctagaaggcccctgagtctcagcccctctatagccctcctgtcacccagacctgatctgggtcttgcaccctgggtgcagcatgacaggggtgggcaggggctggctctgggccagaggaccctttctgatggacttcagctgttggccttccaggggagactgatcaacctcacaagagtcatatggtgagtagcggtgggcaaatccatccccctcatcttagatttatggggagacagagacaaagaggagacactccaggaagacctgcaggtgggagtaccaggttgaaaccaaggacaccttcctggaggagctgccgtttgagccagctctgagaacaggtggagacaggactggagaggaggaggttgtgccctatgagcaaagactggccaccaccccatctaacacccccacagggcccctgtggcatccctgtccagtccctgtcaccacccagtttttccctctggacccaggaattcaaagtaagcaaggaggtccgctgctccagttggctgcaaataattacaaccttgagcccaagcagcactttgggtcctggtttgggaccatgaagcggctcggtgagactgagaggtaaggccagggcaggaattgggatagtaggattgaactctccctgggggccagcctcagaaagcctgtggccatggcctcttggccaacatcagatcctgtggtctggcaatgcctggggtacccagacctcactctggacaggccctgggagggggccctggtgagattcctggcagcctcacagccactcttctgtccatagctacaacctgtcatgccagctggaggctccatcccagttggctgggagcataaagtccaggaagatagacatcacccaccacaggggccagtcagggcctgaaccagggcgggcagaggttggctgccttgggatatgggtgggctcagggagtcagacagcaagggactagcctcccatcctactgctgagcagccctgtgactggggagagtcaccttacttctctgggcctcagtttccccctctgtggagtgacactaaatgatctctctggagacggggatcaatagggtactggtgattgaccaggcactcagcacatgcctggagcacacagtgcagggctgtggtggggaggtgggctgagttcctagggagtcacccatgtgtgcctgccgttctgaccagccaccaggccctcagggcagagcccactaccagcagcagctcacaccccaagaccagctcagaggcggcccctacctcagcagcagggacatcacagacactttgagctggcactagggtggcttctccagctcccacggggagaggggtcccagctgagtcccactcacgtggagtctcatgcccatgaaagtgccattcaccactggccaggctcatgaggccgcatgagaggggggtcactggggaggagatatcgggggaacagagagggtggttgaatttttgtataataggcagtgcaagtgtttaccgtttggcaggggaaaggtttgttattattagcaatgctacacttcaatattacactaaaatccagtttctctataacctgggagttgctcttttgttctttcttttcccatcttaattaaaatgagatgcagactctcacggtccacagtcgattaagaaatcttgcacggccatcaggttatgtcttggagagcagagtttcagtaccatcagcctggcaaggagctgggcctgctcctcagagctcccgggactgcgagaattggcatgttcacaaggcaccgtcacagcctctgaaacacgctgtctttaaagatgtttgcaggctggacgcggtggctcactcctgtaatcccagcactttgggaggcagaagcgggtggctcacttgaggtcaggagttcgagaccaacatggcaaaaccccatctctactaaaaatacaaaaaattagccaggtgtggtggcaggtgcctgtaattccagctactcaggaggctgaggtaggagaactgcttgaacccaggaggtggaggttgcaatgagcagagatcacaccactgcactccagtctgggcaacaagagcaaaacttcatctcaaaaaaaaaaaaaaaaaaaaaaaacacaaaacacaaagacatttgcaaggaccatgtcctcacccagaatggtgcctgcctttctacagtttttcaggaaaaggaaacattttctgcttctctcgctgaggttttttttaaccacccattaggaacctatagatttcaggatcgaacactgggattccctcagcactaaaggaggacaattgcaaacagagctgaaagtgcaatgtggaaaggtcaggctgaggaaggttcttagccagtagaccaagggcaggaaggacactgcctcctcagtctcccactagggaacttgtgattcttgtcccctgacctcagaattccttgtcatgtttgttttgtctccaagggaagggtttgaattacagaatttaaggctagagtgggcctcgtgcagttaacattaaccctctctctccttcgctggccaaggtgaagtccggaaacatgtagttctgacgtccactctctcgggggatcaccagttcacccatctcacccggcaagctgggacctagtttggcgacaggcatcttccacccacctgggaggcagggttcaacactctgcctctgaccttgtttccttcttctgccacctgcttaggcagccagaaggggttgtccagccagcacctgggctttggcgctcctcaagcaggtggaggaagtttcaggcacctggctcctcaggtgtctgccatccaggtgctcttcaggcctgcccagcagagctctcttgatccagctagaactggccagaactgactcactcaggaatgtgtagactttggcatcaggggctgctttaatttgcacaatttccaaatacctcttttttcttctttttctgatgagtcatcttcctagactttcattttaaagagatagatagttatcaggttccagagaagacatggtagaacatttatatctcaaagacacagagctgagacttcagttttagatactataatttgcctaaaccaaaaaggaaggtgtaggtaaagttctagtcaagacaggatggccaggaaaaacaccttaaaccaagggatggcttgctttgctgatttaagccaatggcttctttatcataagacttcccagtgatttagtcctccctctcttccagtgcacagagacatacccctccttacaaataaaaatgttctttatagatgtaaatttattttacaaaaatgtttcaaaataaccagatgaaaatcatccttatgccagaaagacttgttttttttttcattactagaaatgaaacagtaagtatttgttgtattgacatacttaggcttagacctgtgtttaacaagaaagcctaataatagcactgtggttagactgtagcctatttttccaaaccatcattttattattaaggaaacgaaggaccaaatacctttcattcatctgatatgatcctttaaaacacattccactaacaagtcccatttggaacagctgaaaatcttttaataaaactttttaaagatgagctcatggcttagtgtaaatttcacaagcttaattaggtcaaatggaaggaactcagatgagtagttgcccaatcagagcccattatttgtaagtcatcagacccctccatgaccttaaaactccactctgacctgattattgcaaacctatatacaaaaaagtgaaaggattaattttcattcatcaacctctcaatcccagattttcaaagaaaaaacctatgtaaggaatacttaccaaaaccagacaggaaaattagagcctgcatactttagagtcaaatttgttccactacagccaggtcgcatacaattacatcatttggttcttcatacactctagaactgactaggacagagtttagcatagaagaactgtaagaaataggttctgaaacatagaaattgcaaagttcaaaaggctatgaaaaaaactaatgtaaatgagagactcccctcactttgttttaaagaaatagacccatcagagaaatgcaaatcaaaaccacaatgagataccatctcacaccagttagaatggtgatcattaaaaagtcaggaaacaacaggtgctagagaggatgtggagaaataggaacacttttacactgttggtgggactgtaaactagttcaaccattgtggaagacagtgtggccattcctcagggatctagaactagaaataccatttgacccagccatcccactactgggtatatacccaaaggattataaatcgtgctgctataaagacacatgcacacgtatgtttattgcggcactattcacaatagcaaagacttggaaccaacccaaatgtccaacaatgatagactggatgaagaaaatgtggcacatatacaccatagaatactatgcatccataaaaaatgatgagttcatgtcctttgtagggacacggatgaagttggaaaccatcattctcagcaaactatggcaaggacaaaaaaacaaacaccgcatgttctcactcataggtgggaattgaacaatgagaacacttggacacaggaaagggaaaatcacacaccaggcctgttgtggggtggggggaggggggagggatagcattaggagatatgcctaatataaatgatgagttaatgggtgcagcacaccaacatggcacatgtatacatatgcaacaaacctgcacattgtgcatgtgtaccctagaatttaaagtataataaaaaaaataaaaaaataaaaaaataaatagatgttctgtaaaaatatacacaatttttacagacaaatacatttataagttgtttttatcttaaaaattggggatatttcatatttataactaattattgaaccttaagttttcttggccatttataggctaataaactaagaatcatgtaaactaagccaaagtagaatagacataaaagtcctaacacttcaacttcctatccttcaagaagtatacctcgcaaagctcatttgagagaggaaaagctttcctccaccctctgttttacagcgctgaggtttctcatcacatttctatgacttatagcttaaatccatgttacatggtcactggcattgttagtgcttctcttttaatactgtagaaattaatcaatttggtggcgtatttaattaattctatcactagaggattgtaaaattacatatatgaatacctcactttagagaccacttaattttttttccaaggggatatttgactatatttcacttgtgtcttatttaatgattttataatttaaaccctaaattataaatctagaatttagagagtatatttccccactggattacatttttggaattattatatgtgcacaaatattacaaaatcactgtagacacctgaaaactatattatcttttaaaagcaatatttacattaaactggtataacaaaattgtttggtgcattttttccagtacattttgtatatattacatgtttaacctttttttattcagcaaataatttttgagtatctactaagtgctaggttctgcattactaattgaatttaaagagtgaaataacagacatggtctcagacaataaaaattaacattaggtcacctatttacatattttaaaatggtaattatgaaaactttgagattttaaactagataacattataataatacacttgatgttgttaatatttgccagtgagcaaaaaagaaaataaaaagatggttttattcaatatacactttaaaattgcagaaaatagtcaagtttctctgctttgcagtttaatgtctatgtgtttttctctgcaacttggcttttgtggagtgaaacaattattcttccagcccaataaaggcagaagagtaacaataaatctaatattttaaatgcttatcaaaagatagtaaacatattatttcagaatactgagttcaataagttgacctacaaaaaaagccaaactgacagtattactgaataaggaaaggcccaaagagacaaaatactttttattttgtaacctcggtatgatacaacttaccctaactataaagaccctaaattaccaagatgggtgcttataatatggagagtaaaaaaagtcatttcacttttagcttttttatttctctcagaataaaaagtgtataaggagtttataaagaagttgatactataagttagtactacaaagacagcacttttcaagaaaagacttttttctctcttacaaatatcatgttagcagtatttgttttctccagaaataatgaggaaataaaaacataagtatgtgggtaattagtgtagtttcttaaagaaatgagttaggcaacaggctaataatgtatacttcgctggcttttgaatgccaacaatcatattctttataaggcacagagaagatttttctgaagaataagtatgtgaacctgaaaagtaatcgccacttggtagtgacaatatggatagggtgaagggcgtcatcaagaagcaatgaaaagatacatttgcagttaaatttgaaaaccatgatgtttaatacatatagtaataaagaatactttctcctatttcaaaattattttagaattaagatagaagctaaaatacctagggataatgatatgactatcaaaaattaaaaattaaaggacattttgagtattataagttaagaatgagaacttattacccaaagaacaggggataattcattatgctccatatccattgaattaaaagacaggcccattacctggataatttgaaagtttaattttatttaaaagtcttgtttcattcatcaagctaaaggattagctcccagaaatattctaggattgcatatccccaactctgtaggaagtatagaaagaatgttataagggccaccatctaaacattattatgtaaataatttagtaccattccatttgcctttgtagatttaaaaatgtaaatggctttctcatattaggaaacatcacttttcaaaacccagataaacatagtatattgcaagagaataattattttctttattaaaaaatactggatgctaagtccaaaagacataaattattttatactaataactactaacattttattcattaaaatataaaggtcaaagattttaaaatgatctttaaatgattaataacatgttgatctttttcttctttctgtaaacctttttgagtcttaacaatactaaactatacaagcaatattaaatagtatataaacggattaaaatattcaaatttactagaatgtggacattggaaagaatgaaaataaacagaagcataaagcagcagatataaaattaagaaagcaactaagagtgtttaaagtacatattcatctgtagtctaatgtctaccataaacaatgactcttctcagtaaaacacaaattgttcatgaagggaaaaagcatgttgtattagagaatattcaacataatttttttagtactaacttgtgcctggagtattattggtttttccattatgaacttatgcacttgataatttttttcataaaaattgtatgtacaactccattcaaaagcagtttttggtgggttttttttttttttttgagatgagttttgctcttttcacccaggctggagtgcaatggtgcgaatttggctcacagcaacctagcaacctttgcctcctaggctcaggtgattctcttgcctcagcctctcgagtggttagaactacaagcatgcaccaccatgcctggctaattttgtgtttttagtagagacatggttttgccatgttgaccaggctggtcttgaactcctgacctgaggtaatccgcccaccttggcctcccaaagtgctgggtatgggcaagagccaccatacctggcctcaaaagcagtttttaaaagcaaacacaatataacaccaaagttgaaaaatctatgctcacccaaggatgccaggtttaataaattatttatagaatactgcatcaaaaataagacaataacccaaaatataccattaaagatgtatccactcctacaactagagataattaatctatctggtagcaaatgatacttcaatcagtttcagcatgtctgaaatctttaaggacaaaagtgataaaacatgacttcattcttcattagactcttagaacacttgaaggaaaataatttctgaagcacaaagaggtaaagaggtgtaatctttcaaaaagatattcagtgttcaaaatccaagagtgcaatatcaggctgggtgcggtggcttatgcctgtaatcccagcactttgggaggccatggtgggtggatcacctgaggtcaggagttcgagtccagccaggcatggactctggctgtactaaaaacacaaaaattagccaggcatggtggtgtgcacctgtagtcctagctacttgtggggctgagacaggagaatcgcttgaacctgggaggtggaggttgcagtgaaccgagatcatgccacctcactccagcatcagtaacagaatgagattccatctcaaaaaaagaaaagagtgtaatatcggtatacacagataatatactgaatgaaacaaatagaataatttgaagaggtatcttgatgaacaaggagtcattagaaaggttgtattcatgtctttgaaggaaattgcaatgtgagaaattaatactttgactactatactaaaagtttattgctaacatgtattgagttattaacgtgtgttaggcagagtgccatataatttacaagtgttatctcatttattgcaggtgaaatgtaatttcgaactctggaagtataaatgaattagatagaaaaaaattctatttaaatggccaccagtaaatcggtatctaggaacagggtgatacagtgcccaagttttctattcttactaaatgttgtgtttcattttcaatgttttcttggatattgctcttttttggtgattttgatttttttttattttagaaaactaataaattgactcttcttggtactgactcgggttttatagaagaaaaagtaaattctgtacatttacctttacctcatctttttctcttttaaatttactatattttttattttttttgtaattttattttatttttctatgattattatttttattattattatactttaagttttagggtacatgtgcacattgtgcaggttagttacatatgtatacatgtgccatgctggtgcgctgcacccactaactcgtcatctagcattaggtatatctcccaatgctatccctcccacctccccccaccccacaacagtccccagagtgtgatattccccttcctgtgtccatgtgatctcattgttcaattcccacctatgagtgagaatatgcagtgtttggttttttgttcttgcgatagtttactgagtatgatgatttccaatttcatccacatccctacaaaggacatgaactcatcattttttatggctgcatagtattccatgttgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttccgatttctccacatcctctctagcacctgttgtttcctgactttttaatgattgccattctaactggtgtgagatggtatctcattgtggttttgatttgcatttctctgatggccagtgatggtgagcattttttcgtgtgttttttggctgcataaatgtcttcttttgagaagtgtctgttcatgtccttcgcccactttttgatggggttgtttttttcttgtaactttgttggagttcattgtagattctggatattagccctttgtcagatgagtaggttgcgaacattttctcccattttgtaggttgcctgttcactctgatggcagtttcttttgctgtgcagaagctctttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtgtaaggtgtaaggaagggatccagtttcagctttctacatatggctagccagttttcccagcaccatttattaaatagggaatcttttccccattgcttgtttttctcaggtttgtcaaagatcagatagttgtagatatgtggcgttatttctgagggctctgttctgttccattgatctatatctctgttttggtaccagtaccatactgttttggttactgtagccttgtagtatagtttgaagtcaggtagtgtgatacctccagctttgttcttttggcttaggattgacttggcgatgtgggctattttttggttccatatgaactttaaagtagttttttccaattctgtgaagaaaggcattggtagcttgagggggatggcattgaatctgtaaattaccttggggagtatggccattttcacgatattgattcttcctacccatgagcatggaatgttcttccatttgtttgtatcctcttttattttgttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgattttcgtacattgattttgtatcctgagactttgctgaagttgcttatcagcttaaggagattttgggctgagacgatggggttttctagatatacaatcatgtcatctgcaaagagggacaatttgacttcctcttttcctaattgaataccctttatttccttctcctgcctaactgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgcatattgaaccagccttgcatcccagggatgaagcccacttgatcatggtggataagctttttgatgtgctgctggattcattttgccagtattttattgaggatttttgcatcaatgttcatcaaggatattggtctaaaattctctttttttgttgtgtctctgcctggctttggtatcagaatgatgctggcctcataaaaagagttagggaggattccctctttttctattgattggaatagtttcagaaggaatggtaccagctcctccttctacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcctctttatcattttttattgcgtctatttgattcttctcttttttctttattagtcttgctagcggtctatcaattttgttgatcctttcaaaaaaccagctcctggattcactaattttttgaatggtttttttgtgtctctatttccttcagttctgctctgattttaattatttcttgccttctgctagcttttgaatgtgtttgctcttgcttttctagttcttttaattgtgaggttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcattatgtacccagtagtcattcaggagtaggttgttcagtttccatgtagttgaatggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctactaggtccgcttggtgcagagctgagttcaattcctgggtatccttgttgactttctgtctcgttgatctgcctaatgttgacagtggggtgttaaagtctgccattattaatgtgtgggagtctaaagtctctttgtaggtcactcaggacttgctttatgaatcttggtgctcctgtagtgggtgcatatatatttaggatagttagctcttcttgttgaattgatccctttaccattatgtaatggccttctttgtctcttttgatctttgttggtttaaagtctgttttatcatagactaggattgcaacccctgcctttttttgttttccatttgcttggtagatgttcctccatccttttattttgagcctatgtgtgtctctgcatgtgagatgggtttcctgaatatagcacactgatgggtcttgactctttatccaattttccagtctgtgtcttttaattggagcatttagtccatttacatttaaagttaatattgttatgtgtgaatttgatcctgtcattatgatgttagctggttattttgcttgttagttgatgcagtttcttcctagtcttgatggtctttacattttggcatgattttgcagtggctggtactggttgttcctttccatgtttagcgcttccttcaggagctcttttagggcaggcctggtggtgacaaaatctctcagcatttgcttgtctgtaaagtattttatttctccttcgcttatgaagcttagtttggctggatatgaaattctgggttgaaaattcttttctttaagaatgttgaatattggcccccactctcttctggcttgtagggtttctgccaagagatccgctgttagtctgatgggcttccctttgagggtaacccgacctttctctctggctgcccttaacattttttccttcatttcaactttggtgaatctgacaattatgtgtcttggagttgctcttcttgaggagtatctttgtggcgttctctgtatttcctgaatatgaacgttggcctgccttgctagattggggaagttctcctggataatatcctgcagagtgttttccaacttggttccattctccccatcactttcaggtacaccaatcagacatagatttggtcttttcagatagtcccatatttcttggaggctttgctcattccttttaattctgttttctctaaacttcccttcttgcttcatttcattcgtttcatcttccatcgctgatactctttcttccagttgatcacattagctcctgaggctttgcattcttcacgtagttctggagacttggttttcagctccatcagctcctttaagcacttctctgtattgattattctagttatacattcttctaaatttttttcaaagttttcaacttctttgcctttggtttgaatgtcctcccgtagctcagagtaatttgatcgtctgaagccttcttctctcagctcatcaaagtcattctccatccagctttgttctgttgctggtaaggaactgcgttcctttggaggaggagagcgctctgctttttagagtttccagtttttctgttctgttttttccccatgtttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtatcagtgtgcccctgctggggggtgcctcccagttaggctgctctggggtcaggggtcagggacccacttgaggaggcagtctgcccgttctcagatctccagctgcgtgctgggagaacaactgctctcttcaaagctgtcagacagggacatttaagtctgcagagattactgctgtctttttgtctgtgccctgcccccagaggtggagcctacagaggcaggcaggcctccttgagctgtggtgggctccacccagttcgagcttcccggctgctttgtttacctaagcaagcctgggcaatggtgggcgcccctcccccagcctcgctgccgccttgcagtttgatctcagactgctgtgctagcaatcagcgagactccgtgggcgtaggaccctccgagccaggtgcaggatataatctcgtggtgcgccgttttttaagtccatcggaaaagcgcagtattcgggtgggagttacccgattttccaggtgccgtccatcacccctttctttgactcggaaagggaactccctgaccccttgcgcttcccaagtgaggcaattcctcgccctgctttggctcgcgcacggtgcgcgcacccactgacctgtgcccactgtctggcactccctagtgagatgaacccggtacctcagatggaaatgcagaaatcaccgtcttctgtgtcgctcacgctgggagctgtagactggagctgttcctatttggccatcttggctcctcccccttaaatttactttaattgacatataataaatgtacatgttatggggtacagagtgatattttgatatatttatacgatgtgtaaagatcaagtcagagtcattatcatatccattacctaaatcatgtattatttctttgcagtgagaatattcaaaatcttttattttagttatttgaaaacacacaataaattcccattaactacagtcacccaacagtgctgtagagaactagaacttcttccttctctccagctgtaattttgtatgtattaaccacatttttcttatactcttctttctcctactctttccaggatatggtaaccaaaactctactatctacttctacgggattaaaaattttagcttccatacataagtgagaacacgtagttatgtggtgtttatgtttctatgccaggcttatttcacctaacataatgccctccacttgcattcttgttgccacaaataacaggattttgttctttattatgactaaataatattccattatatatgtatgtcacatttctttatccattcatctgttgatggacacttttgttgattccatatcttggctattgtgaatagtactgtaataaacatgggggtgcaggtaactctttgatatactgattttctttcctttggatatatactgaaaaccatatgattaaattaataaacacaataaaagcgtttggcaaaattaaatattcttacatgacaaaaaacctctcaacaatttagtatagaaaatatatgccttaacacagaaggacataaaggacaaatctacagctaagatcatactgagtgtggaaaacgtgaaagattttactgtgaacaagaaaaagattttactggaacaggaaaaggatgcctattctcaccaatcatatttcacatagtgaaagtcttagccaggacaattaggtgagagaaagaaataaaggacatctgaattggaaaggagacagtcaaactgtccctgtttaaagacaatgtgatcttatacacggaaaaaaataagactctaccaaaagcttcttagggtgatacatgaaattaataaagttgcaggatataaatcaacatacaaaaatcagtagcatttctatatattgatagtaaactagctgaaacaagaaattaagaaagcaattccttttacaatagctacaaaaatgtacttagaaataaatttaaccaaggaagtaaaagatttcgacaacaaaaatgacaaatactaatgaaagaaattaaagaaaacacaaaaaaggaaagacatccacgtttatagattgaaataatattcttaaaatgacccactatcctatgtgatttacaaatttagtacaatcactagcttgtatttttaaaagcacctttgctgcatattcttaagatattcaatgacaatgcctggatttaagtttgaggtattattatatctattttatactgggcacaatataatgttatcagaggtaatggttttgattggtcctaggtcatacagtaatatatacattgtgatttatagacatgctatcttttaatactcaggcatttacaaagttcatttagacaaagttataaaaacttgccttcctttccgcctatatcacctaaaaatcctaatttaagaggtaataacattttttgatatacaatttatcaacacaataaaaatctaacaattatcatgtgcagagtgtgaaaatctcatcagattaaggaacacaaagacatctttttcatatttcgaatgtaaaactgttttggaaactgttatttttagaaacagttaaaaacattttttcattagtttttcatgtaaaattgtgacaaccagcatgaaataactgtcatcacagaagcatggtatattcgattccaaaacatattctttgtaagttttaatatatttatgtattatttatacttacattgtaacccataatgtacagatattatttttccttcaactcttaagaatattcttaaataataaaaaattaatgatttataatttttgttggttgggaaaaagaatagacacacacgtgacagtgcatcacttcacctcatcatttcatctcatcattttatctcatcatttcatctcatcattttatctcatcatttcatctcatctcatctcatcccatcatttcatatcatctcatttcatcaaatctcatctcatctcatttccatttcattttcattatttcatttcatcatttcatttcactatttcatttcatttcatctaatttcatttatttcattatgtcatttcatatcatctcatttcatttcatctcatattttttatatcatttttcatatcatttttcatctcatcatttcatctcaattcatttcatctcatcatttcatctcctcatctcatcatttcctcctttcaacatttcatctcatttcttctcatctcatttcaatttcatttcattatttcatctcatttcattatttcacctaatttcattatttcatctcatctcatctcaattcatcatttcatctcatttttcatctcatcatttttcatctcatcatctaatctcatttcacttcatttcatctcatcatttcagctcatcatttcatgtcacatctcatttcatcatttcatttcaacatttcatttcatctcatctttcaatttcatttcaatatcatcatttcttttcatttcatctcatttcattatttcatttcatttcatctcaccatttcatctcatcatttttcatctcatcatctcatctcatcatttcatcatttcatctcatttcttctcatcatttcatctcatcattttatctcatttcatctcatctcatttcaatttcatttcattatttcatttcatttcacttcatttcatctcatcattttatctcatctcatttcatctcatttcttctcatctcatcatttcatcatttcatcttgtttcatctcatttcatctcacctcatctcatcatttcatctcaacatttcatctcttcctttcatttcatctcatcgtttcgtctcatctcatctcatctcacctcagcatttcatcatttcatctcatcatttcttatttcatctcattttatctcatttcatctcatatctcaattcaatttcctttcattatttcatttcatctcattcatttcatctcatttcattacatctcatcatttcctctcatcattacatctcatctcatctcatcatttcatcatttcatctcatcattgcatctcatcatttcaaatccatcattcatctcgtcatttcatctcatcatttccatttcatcatttcatttcatcatttaatttcatcatctcatttaatttcacctcatttcattatttcatttcattttttcatttatgtcatttcatttcatctcattacatttcgtctaatttcatttcatcccatttcatctcatcatttcatctcatcttttcatctcatcatttcatctcatcttttcatctcatcattttatctcatcatctcatcaactcttttcatcttatcatttcatcatttcatctcatctcatatcttctcatctcatttcaatttcatgtcattatttcatttcattatttcatgtcatctcatctcatcatttcatctcatcatttcatcattttatttcatcatctcatcttatcatttcatctcatttcaattttatttcaatttcattatttcatttcatttcatctcatcagttcatctcatcatttcatctcatcatctcatctcatcatttcatctcatcactcatctcatttcatatcatcattttatctcatctcatcatttcatctcatttcatctcatctcatttcatcattacatctcatttcatctcattttatgtcatcatttcatgtcatcatttcatcacatctcatcgtttcatctcatcatttcatcatttcatctcatttcaactcattgcatctcatctcatcatttccatttcattattccatttcatcatttcatttcattatgtcatttcatctcatcatatttcatctcatctcatcatttcatttcatctcatcatttcatctcatcatttcatctcattttatctcatctcatcatttcatcatttcatctcatcatttcttctcatctcatcatttcattatttcatttcatctcatttcattatttcatttgtcatttcatctcattacatttcatctcatcatttcatccatcatttcatttcatcatttcatctcatgatttcatctcatctcatctcgttatcgcatttcatctcattattgcatctcatttcatctcatctcatcatttcatttcatcattacatctcatcatttcaactcatttcaatttcatttcaatttcatcattacatttcataatttcctttcattatttcatttcatttcatctcatttcattatttcatttcatctcatttttcatctcatttcatctcatcatttcatctcatcattcatctcatttcatctcatcattttatctcattatttcatctcatctcatctcatttcaatttcattatttcatatcatttcattatttcatttcatctcatcatttcatctcgtttcatctcatcatttcatccatcatctcatcatttcatctcatttcatctcatctcatctcctttcaatttcttttcaattttgtcatttcgtctcatcatttcatctcatcgtttctactcaccatttcatctcaaaatttcatctcatcatctcatctcatctcatcatttcgtcatttcatctcatctcaagtcatcttatcatttcatctaagtgaaatgatgtaatggaatcatgaaatgaaatggataggatgccctcagtgatgttaaatttaaaaattgtttcttttcatgtatgcatttttatatttatatgtatttatatttatatttacttatatttctttttacttatttttatttatatttttacttatttctttatttatagacaaggtcctgttctgtggcctaggctggaatgcagtggtgcattcacagttcactgcagcctcgagcaaacctcccaccttagcctcccaggtggctgggaccccaggtgcacaccaccacacctggttaatattttattatttgtagagatggagtcttgctattctgcccaggctggtctcaaactcctgggctcaagcaatcctcctgcattggcaacccaaaatgctgggatgacagatatgagccacagtgcccaacctatttatttatttatttatttaataaggacaaggtctcactatgttgcccaggctggtcaactcctggactcaaatgattctccaaacgtggcctctcaaaatgttgggattacaggtatgagccaccatgcctggctaaaaatagtattatatttttgtatcatataattttcaattaggtaatatgaatattctgtacaggaaatacgcccttaattacataggaataaacatttgttacactgagaaaaatctaacagagctaaaaataaaaattaatttggaaaggtcattagatactgacacattcttacgtttatacattctttcatatattcatatattcttttaacagtatcaatggtttggagttatgtgtacaaaaccatgacctatatgtaatacaactaataacaggcacttacaattcaaggcatattatatacaaagctttaacttcttatcaaaatattttgttttttttctttctgttttggcagatactatgaatacaacattcaactcacagacaccatggagcccttactaagcataaagtactgtgaaaggccagggctaggacagaactgagacagggccagggataggacagaaccggggcagggtcatggccagagaaaaaccaggggcagggtcacagccagggacatgagaggaccaaggccagggccagaagcagggcagaaccagggccagggcagggacatggcagggccagggccatggcaggatcagggtcagcagaaggccagggcagggctagggtagcacagggccaaggcagggcagggtcagtgtagagcaaggaacgggccagggtatggcagggcagggacagggaggtccagggccagagtcaggtccagcacatggacagggcagggccagaaacatggcaggaccagaaaggggacagggcaagggcaaggccagagaaggaccatggaaaaaacatggccagggagggtccagggcaagggcaaggccagggcagaaccagagccagggcaggccaaaggcagggccagggcagggcaaggccagggtagggtggggccagggtagggtgagggtagggccagggcgagttcagggccagggcaggactaagatagcacagggccaaggcagggccagggcagggccaaaaggaggggccagggccaagcatggccagtgtcagacctggggattgtcagggccagggtcagggtcaaggctgggccagggacagggccagagcaagggcagggccagggagaaagcagaaccagagaggatccagagcaaggccagggtcagggaagaaccaggaccaggataaggcaaagccaaggccagggcagggcaagaccagggcagggcaagaccagggcagggcaaggccagggtagggccaggccagggtaggagaaggccatgatagggccaaggccaaggcagggcagggctagggtagcacagggcatggccaaaaacagggcagggccatagcagtggcaggactagcaacagggccagggcaagcgctggaccacagcatggtggggacaatacagggccaggacagaggatggcaaggcaggtccagggccatttcatggactcggtaggcctggggtcaggccagggcagggcaaaggcaaggccagggagaaggcaaggccggggccaaggcagtgccagggcagggcaggaccagtgcagggccaacgcagggtgagggcaaggccagggcatggaagggcagggcaggaccaaggggaagggccaggagagggccacggcagggtcacggccagaacaagggtatggctggggtcaggaatatggtaggacgagggctgggcccaggctgggacacgcagggcagagcatggcctgtgcaaggcacggccagagccaggccatagagatgggagggcaacaccaaggcagagtcagggtagatccagggctgagcagagtcagggcaggtccagagtcgaggcagagctagggcccaagcagggccatggtagcaccagggcagaggagggcagggcaatgcaggactgggccatggcagtgcctggtcaactccggggcagggccagaagcaggacagggccagggccaatgctcaggccagggacagggcatgacaggacgtgccagagcagggctgggccaatgttggggcaggacaaatcagaccaggacacctccaagtccagctctggccctgccttggccctggacccttcctggcctgaccttgtccctggccctgccctatccatgccctgtgtgtttgaccactgttttataaccagaatcctacaagaaacttaaattagttctttttgtgcatttttagtagagatggggtttcacaatgttgaccaggctggttccaaactcctgagctcaagccatctgcctgccttggcctcccaaagtgctgggattacaggagtaatctggccaagtatttaacttctttatgcctgtttcctacatttggaaaatggggatgctttaagtacctagcacatagaattattgtgagaatcaatgcctcacatatttacatattgataaaattatactcatagaacactactggaaacaaagacagtattagttaaaatttagtgattactgcaaatattattactattacaaacaacatagtatagacattactactactatagttatcttaaaaatctaaaataaaaattttacataatagcctaatgtaatctctcctgctctgccctggctcagccctagtgctggctctgcccctagtcctactacatccctggccctgacccttccctggtccagccgctgccctggcccttcccatcttcaggccttaccacggccctaccctggtcctgaccctgccctggtctggtcctgaccctggccctaccccacagaaggggtatggcagagccagggaagggccagggcaaataagtgacaggacacatccaaatccaggaaagggccagggctatgacagagccagggcaagtccttggcagggccaggttccaggccagggccaggaaagggtcatggcagggtcactgtatggccaaggtccaggccaaagccaaggcagtggcagggtcagggctgcataagggcaggaccagagccagtgatacggcagggccagggccagggccagggctgtgccaggacagaacaagagcagagcagggcaggaccagagccaggccatagagagagtagggcaaatgccaaggcaaggccagggtagtgccagggctgaggcaaggtcagggaaggtccagggctgagtcaaggctagaaccaagacaggggcaaaggccggggcagatctagggcacaagcagagcaggctagggcagggcaatggcaagaccaggccatggcagggccagcccaggatagaagagggcacaggcagggcagggccagggccacagctggggcaggacaaggaccaggaccggggtccaggccagggcaagggtatggccagggcagaggtaggccagagccagggtctgggcaggaccaaggcaggtctgttgcagggccagggttcagaccagggccagagcagggctgggacagggccagggccagaaccaggaaagggcaatgtcaggacaagggccatggcaggaccagcaacggggctggggccaggacagggtcaggaccagggctgggccagggtatggccttaagtagcgaagggccagggccagggtccatgccagtgccagcgccggtccagggcagacgcagggccatggccaggtctaggacaaggctggggcagggccaaggtctgggtcagggtcagcacaagaccaggacagagccaggggagggacagggccatggtaagaccagattaaatcagggacaagacacctgcaaatccacttcagggccagggtcagggcagggccagttcagggccagggccagggccaagacagggccagggttagggctcccagggtcattggcagggccagggtcagggctgccagggtcattggcagggccagggccatggcaggaccagggtcaggagcaggggtcaatgccaggccaaggccacacataggaccaggtctgtgctagggccagtgtgagggccaaggcggggtcagggcagggccaaagggagggcagggccagggcagggtgatgcaggcccagggtagcacagggttaaggtagggcacgaccaaccagggcaggtctatggctggggccggggcagggccagggccagggcagggccagagccagggcagggccaagacagtggcagctccagggcagggccagggttaggaccacggacatgtccaaggccagtgccagggcaagggcaagggcaggggcagggccaggttcatctaagaaccagggacaaagccaggcccagagatgggccaggacaggtacctggcagggctagggtctgggccagggccacggcagggccagggccacaaccaggtctgtgctatagccaggtccaacacagtgcccaggtaaggctaggtagaaggccaaggtagggccagggcagggtcaaagccaggctagggccaaggcagggccagggctggcaaggcagggccaggaaagcatagggccaaggcagggcagggccaggccagtaccaagacctgggcagggccaggggcagggccaggggcagggccacggccacagcctaggcaggaccaggttcggggcaggagcaaaacaagggtaaggacagtgcaggttcttggcacagccagggtccaggacagtgtcagggcagggccaaggcagggtctgggccttgataagaccagcaacagggctggggctaggccagtgacaggaccagagtcagggcaagggccagagcagtgcaaggccagggtagggccaggcatttcagggtcagggccaggggagaaccagggcaaggtctgaagcagggaagggccagggccaggacaggtccagggcagggccatgacacggccaggggctgcgttagggcaagggcagggccagagcaaggtaagggtcagggccaaggccagggtagggacagggcaagaaatatggcaggaccaggggcaatgccaaggccaaggctgggccagggctgagccagggctgagtcagggcagggcaaggcagggcatggtatggccagtgcaggacaggacaagagccagtccagagagagagcagggctgatgccaagaaagagccaggctagtgccgaggctgaggcagtgtcagagcatgtccagggcagggccggggccagggacagaaccgagccagggcacagccaagacagggtagggcagggaaatagcatggctgggtcagtactgggacagggcagagcagggcaaggcgatggtagcggcagggcagggacaggccaatgcagagccatgtcatgccggggccaggacacctccaagtccacttcaggcccagggctatggcaggacaaagaccagggccaggatcagggccaggtctgtgctagggccagctccagatgagggtctagcgaagactagggtgagggccaaggtaaggccagggcagggtcaaaggcagagtagggccaggtcagggtgatgacacatccagagcacaacagggcagggtgatggcaagaccaggggcagaccactgccagctcagggccaaggaaaggccagtgcagagccaggaaagggtctgggtctgaacaaggcagagcagggccagggccatggcagagtcagggcaggtccttgacaggaccaggttccaggccagggctagggcagcagcaggggcagggcctggataagggcagggccagggatatggcaggaccagggctagggccagggccaggccatagtgagggcagggcaaaagccaaggcagggtcagggcaggtccagggcaggtccagggagcggccagcaccaagcggggccaaggcacaaccagcgcagggtaaggcaggacaatggcaccactgggccatgacagggcaaggtcagcaccaggagagggcagaacaggcaggcccatggtggggccagggcagggatgggccaaagcagggccaggacatgtccaaggccaggtcagggccagaacaggagcaggaccatgaccattggcagggccagtgccatgacaggaccagggtcaggacaaggggcagggccagagccagggccagaaccaaggtcaggccagtgcaggttcagggcagggccagtgccagggcaagaccagggcagggacagggtagcacagggccaagacagggtcaggatgggaccagagcaggacagggccgagagtccaggtaacagtagagcaggtatagggcaaggcagggcagtacagggccagatccatggcaggcgcagggcaaagccaggcccattgccaatgcaccagccctccctacaaggctcctaccacctggccactgctgcagcccgtccatcgctgtaagcctgaaccccaaccctggctgcagccacctgccctcctagtgcggccgctctcctaccgctctggcgcactgcaatctccgtcactgccacccacccgcagcgaggcaagccgtggtgtcgcaggctcaaggtgtctcctcctcctcctggcacggagcagctgggcaggcaaagccagaaaagcctagaggaagatgtgaggggtggaagggttagagcctcaacttgtcatgccagccactgggtggcaggggccagtttcagcaaaggcactcacacccaccctccaaagtccagcctctccttttggcccaagctggccgggaactggggtctggggtgggtgctggagatatcacagcacccagctccccactccacaggaaccattgggcccaccggggctgcactcctcggggagcaggagaagcagaaaaattcagacccagccagccctccgcacccaggtgccaattcctgttccggacgcctccacgcacagggccctgtcccccatggtgtccccaggggtgcctggcagcctctgaggcacagacccagagtgcacaggcccaggaaccacggtgggtgtgggggctctgccatgctcaggattcccacgcaaacgctgtgtgccctgccgcattccagtatgaccaagagtgggtcgccctctggagtgtggagtcagggagaggagaaccactccttccttggatgccaactctgttgaccgccgccagcagtgcagcccctgatagcaccgaactcgcccccgctccacggctagtcctgccctcaatagcgccccccacctccgtcccccaatgccgccagtagcgtatacccgataatgccctaacctgtcctcctccatgggcactgaagccccagaaagcgcccataacccaccctccctgctgtgggcagtgcagccctgtacagtgctaccaaccagtacccctaatgcaggcaatgacaccctggatagcgcccccaacccaccccacactgcgaaaggtgcagccctggatagcccctgtcctaccactctgttcatgctgcagtctctgtcaccaccaccagcaaccacagtgaggcaagccagtgggccgcaggctctagcatccagcagccaggcatggagcagctctcgctgatggccggctcctaccactctgaccatgctgctgtctgtctccatggccatcttctttcactacaaaggaataaaactaggtatcaataagaaaagtaattttggaaacaatacaatcacatggaagttaaacactaccctcctgaataaatgactagcaggtcaatgaagatactaagacagaaattcaaaaatttcatgaaacaaagggtaatgaaaacacagtataccaaaacttgttacgcagaaagccatacaaaggcagagatttacagctacaagtgcctaccatccaaacaaaagaaaaacttcaaataaacaatacatcttaaagaactagtaaagaacaaactaaaccgaaaataagaaaataaataagatcgtagcagaaacaaaattgaaataaaaaacacacaagattaaacgaaaagttggttttctggaaagctaaacaaaattgacaaacttttaaccaggctaagaaaagagacaagattcaaataaataaaatcaacagattaaaaaaaggagacattacaactaatacttcagaaattcaaaggatcataactggctattatatgccaataaattggaaagcctagtagaaattggcaaattcctagatgcatacaacctacttaggttaaacaatgaaaacatccaagaccagaacagattggtaacaagtaatgagattgaagccatcagaaaaagtctcccagtaaagaaaagcccaggaactgatgtcttcactgctgatggcttcacaccaaacaatttaaagacctagtacgaatcctgctcaaactattttgaaaaacaggagggaatacttccaaacttattctatgagaccattattactgtgataacaaaatcagacaaaagcatcaaagaaggaaactacaggccaggatctctaatattgatgcaaaaatcctcaacaaaataccagtgaatcaaattcagtaatacattaaagagataattcatcatgatcaagtgggatgtatccctgggatgcaagggtcactcaacatacaatgtgatacatcatatcaaccaaataaacgacaaaaacagtatgatcacgtcaactgaaaccgaaaaagcatttgatgaaattcaacatcccttcatgctataaatcctcaaagaaacgggcacagaagaaacataccgcaacataataaaaactacaggaaagacacccacagctagaatcatatggaatggggaaaaacggaaagcttttcctctaagatctggaacatgataaggatgccccctgtcaccactgttgtttaacatagtaccagaaatcctagctaaagcaatcagtacagcccctgatatggcccccaacccaccctgccccctaccaccagcagtgtcgcccccccgcaacagcacacccaacatacccaagccgccccgcctccccgcaccatgggcattacagcaccccatagcgccctcaacccgaaaccgccacccacccccccaccgcccacagccgcacagtgcagccccggatagcacacttagcccacctcactgttgccagcaatacagtctgggatagtgcccccaaccggctccccgccaaaggcagtgcagccccggtttgggcccccaaaccatccccccgtgcaggcagcacagccccagatagcacacccaaccagccacccaagacgggcagtgacgcctgagatagggctcccaaccggtcccaggccacccgcagtgcagcctggatagcgcgcttaccccaacgcctttctacgctctggctggctgcagtgtccatcgctgccaccaaccacaaacagggctgcaaacaggaaggattttattcaccgtcgatgcggccccgaggtgtcccaaagcgaggcagtgcccccaaggtctgtgcagagcagaacgcagctccgccctcgcggtgccaccggcccgcccgcccgggtctgtgctgaggagaacattgctctgccttcgctgtatctccgaagtctgtgcaaaggagaactcagctccgccctcgcaaaggcacacagcgccggcgtggcggagaggcggacagcggcggagaggcggacagcggcggagaggcggacagcggcggcgcggcggagaggcggacagcggcggagaggcgcacagcggcggcgcaggcgcggagaggcgcacagcggcggcgcaggcgcggagaggggcacagcggcggcgcaggcgcggagaggcgcacagcgcggcacagcgaggcgccggcccagactccactccccagctgtgaaagggtaagaactgagggtggctgagactcggggttgttcagggcggggtgggctctggacccagcaggcccggcacccaggtcagggctccaggggaggccaggtgggcgaaggccaagaaggggccggggctggtcaggaagggctcctggtaaccagagcactttgcgtgagccagcgtgggaggaaggtgggctggatgagctagggaggcgccgggaggggccttggcagaggcgaccccctccgtcagcccccaggccactgaaccctgggtagcgagaaccgacaggggaggctgcatacagaggagtggaggctccccggctttgggggctctgagtagaagcatctagggggtccctcaagaggcccccaaacgcctccccatggtgagaaaagaaagcgcagagaggggcacggctgtgatttcttttattgccccaaatgtacttcatcttggtagatttctattggctttaaaaatgtgtgtgttttgctgttggggagtggggtgttatacggatgtcagattttgctggttgactgttcagatcttttgtaaatccttgctccttttctgcctagtttcactctgtcacttacattagagtgcggtggcacgaacatgactcactgcagccttgacttcctagggtcaagtacttcccctggcttaacctcctgagtagctggtactataggtgtgtgccgccacacctggctaaatttaaaattttttggagagatgaggccttgctatgttgcccaggctcgaactcctggcctcgagctatcctttgtctttgcctcccagagttctgggattacaggcatgagccactgtgcccggcctctgcctagttttaacagttgctaagaggaggatgttgaagtagatgtcttcttggtgggttaatccttttgtcattaagcagttgttatggtcacttccttttcaccccattggtgaaggaggggtccctgccctaaagtgtaggagatggctgaacacgacacctggcgtggatggatgagattgacagcagtgttttagtcacatatacccacagctcagaggaggacactgcatgccacacagggtcagatgggcaccgcactctgtagcggagtgagggctgtgggctgaggaagcaggcaggcttgatagtaacaagagcacacaatgaccaatggttcccgagggggaatgcagttggcttgtttgaataaattcatgggctggcagacaggtgaagtgaagcttcttaggctgaggtgcaactgtttggctgataaaagaactagccaggtggggagcctttcctgttgggtggcagggtagggggtgtctggtagaaacaggaaaacccacggctaggcctttggggccctgtgaggctcaaagatgtcaaggcagcataggaaattttagatcttaaaattcagcgaagaccctctccagctctggtaaattattttgcttgaagtctacttcatgagatattaatatattcactcctgcttccttaaaaaattaatgatttcacaggatatctttctccattcttttactttcaacctacttaggtccttaagtgagtttgaagtttcttatgaacagtatttagttgggccatgtgtttattataggctctccatcaatctgtcttttggtttatttagaccatttacatttaaggtgcttatagttacataattgcttatgtctgatgtttttattatttgctttttcgtttcctttttctttccctccatcttgatctatttctgtataatgttgttgctcgtatctctttgtatagtcttaaagtgtttgctctggatgttacaatatgtgtattgtaatacagtagtctactggtaccagtatttaccacttcaaagtgtggaaacctgccttgcatttatgtctctttaccttttccacttgtataaatcactggcttgagtattaggtggtggtatagtttttgtttcagtcgtcaaatgtgattttaagaactgtggattgtctcgcgtatgtatccacatttctggtctttcctttgtccctcctcctatagtcccatattcatcccttctgcataagaactttctgtagccatttttttgttttgatttttttgttttaattttttgtattgtggaaatgacagaacatatttctgtagccactttttagcatttctaaattgaccagtgacaaattcctatattctcttcctctgagaatgtctttatttctctcttcatttctgaagggtagtttcatgggatatagaatttgcagcgaacagtttttttgtttggttggtttttttgtttggttgttttttttttaaacacttgaaaatgttgtgccacttccttctggcctccatggcatttgagttggcgtgtccctacaggcattctgccatttttggtctttgtttttagttttgaaagtttaattggtgttgctttcttttggtatactttgaggtttgctcagcttcttgaatctgtaagtttatatctttcaccaaatgtgggaagcctcaggaattagttatttgcatgctttcacagctctggtctcctatgggactcagataacataaatgcggggttatcgtcccacaggtccgtgcagctctgttcatttgttttcaggttattttctctctcttgtttagactgggtgaattctgttgatcaggtttcagcttctctgattctctcctctgtcgtctccacttttactcaatagggcccatccagttagtttttttaaaatttctgttactggattttatatttctgtaatttccatttgattcttcagtttctttgctgatgttttcagttctttgattgttgccataggatttgtagttgcttgttgaagcatttttatactgactgttataagtgatgagtcagatggttccaacatctgcctatgtaatttttttatttttgcaggcagtcctcctgtttaggtttagtctgtaggtcttggtctactttgtgggctgtgattccaatggcaatttaatttcagagccttcatggtgttattttggtctctttggcttatatgtatcactgggattctcccaccagtccctgttgttgcccacctgagggaacaggggagccgccctaggctgggccacctgctgcagctaggtgggtggggaatggtggttgtcttggtgtgtggagctggttttcttgttgtggggaagatctcctttgatctgcggggactgagtctgcctgggttgccttctattgctacgttgggagttgggaaactctgggcctgggtcaccttcctattggatgaggtccagggagacacctggccactatgcattccctagtcctagagtccctcagcagcctttttctgtccaccttttggaattctccattgatcctctcctgtctattatttctagagtttgggttacatttcttaggagggtataatgtgttatcttctctagaccagaaatccttagtggtggtttcgggttgtaactgtgctaaagggagaattggcgtatttgtgatgtcgggtctttcttttcaaatgaggacatatcattattcagtatataatatttacaacacctacttccttgggttgaagaatgtggttaaggcaaggaaagtacttaacacagtgcctggtgtggagagcacttacgagtgttggtagtgatgctattccttttgtcctttggtagcctattaaagcttttcttcttttttaaaaaaataaagttccggtgcacttcttgttaggtttattcctattttatccttttttgcttttattgcaaataggagcttcctatcttttataacgtctacctggttctttggcccttacgtgaaaatgttttaatagccttctaaacattgttctctcaaatgagttttaatttgcctctttcttttgttttcctttttttgagacagggtctcactctgtcacccaggctggagttcagtgacgcaattatggctcactgcaacctctgcctcctgggcccccaaagtgctgggtttacaggtgtgggccactgcacccagccttacttgtctgtttcttttaagagtgggaactataattgagcccagagctccaaaaacaaatgaagaaatgaatgagtgaataagctcttcccatgggtttggtgtggtttgggactctactcttaatctaaatgctatgttttatataatctaaaatttcccctaggtgtgttacacgattgtgttgtgttgaacttacattgagactccttttcacatgtgctggttatcagcgtgggacttttccattcactctttgaattattcgtttgggggacacagatagacctctgtgtctttcataaagagtgtccattggccggttgcagtgtctcatgcctgtaatcccagcactttgggaggctgaggagggcagatcacgaggtcaggagttcgagaccagcctggccaatatggtgaaatcccatctctactaaaaatacaaaaattagccaggcctggtggcgggtgcctataatcccagctgctcgggagactgaggcagtagaattgcttgaacctgggaggcagaggttgcagtgagctgagatcgtgccactgcactccagcttgagtgacagagtgagactccgtctccaaaaaaaaaaaaaacaaaaacaaaagagtgtccattatctatactagaaaaattgagattgggattttgacatgaagtgcggaaatgtggattgggtccatttagtttacctaaacagatgatgaaatactaactgttttacgaagcattccctagtgcaaagttttgcctgtgtttctagtgatgggaacagtgagaatcagacttggaacacggagcgcattgtgggcctgtcgtgggtggggccagcagcacatgcatgccgggctgacagagcagcctttgggtgttcttttcccagaggagctctacggtgactttgaagacttggaaacaggggacgtgcacaagggaaaatcgggccccgatactcaggtatgactttgtcgtagctggctgttcttggtcattgtgttctgagagaggcccgcattgagaaatgcaaatcttacttgtgatgtgtgaagattgcagactggatggatagattccttcctaaagtgtggggatgtggggaccaaagagaagctttcttatttacttgttaagttttggactacagttactaccgtttcttgccatagtcatttgccaagtccactgtgatttttcactcacagaagtcttagcttctcagacttacattcaaccattgccatcattctcctctttttaaatttaagtgtcatttaaaagaatgaaatccctgttctccctaatatttctttagaacagggtctgggagcatctgggtgagggacatgtctgttatttttattctagtttgtgttcccagccagcttaaggaatagcagctagttgtaatgcagatgtaacaatttcctgtagcagtaccatgttattcagagacaaaggttatgttgtgttttgttttgttttattgataatgataacagatttttgctaagatttttgtttaaatagaactttaaaaaatctaatgtttaaagaaaagaccttcataaacatacacaaaattttttcttctggaaatttaagaatgaagatgtagagaaacaaggaagaaattgaccctgacgaagaagaaagtgccaagaaaaagcatttggataagaagagaaaattgaaggagatgtttgatgtggaatatgatgaaggagaaagcacatattttgatgatcttaaaggagaaatgcagaaacaagcacaggtgagaaacctcagttcctctcagccccttgtcaagactatcacatagtgtaggaatccctgactttctttgggtccctgcttcctatcctgcttctgtgcctttcacttggactcctgggtagatgcatgtgagtgtgtttattcatgcagtgagctcattgtttctacagtcagaaggtcaccagaaaaagatccatacctattttgtaacaagaattaggaaaccgaaatgactgagacatggtctctacttttgagacttttacaatgtagcgatctgagatagtgtgttcatttcagtgcaagccaatgctgcctattccgatcgctgctccctgatttgaatggcaggtgatcagtggcccgtgtggcttatggacacaccagagctcccaggggaagtgctctgaaaacatcctggtcagagttcagaaggacatgtggagtataaggtcagatgcggagataagggagatggtgtggccctcctgcccaggggtgctgagcaggttgctggaggcggtgatctcactctgaaggagacagacacagaaacgtatgtacagttgatggtgagcatctgagttgcgtcttgttagtgaggccaggagtgcctgtgtaagctggaacagattaggtatatgatttgtgaaacggagtttcatcctacgtcttcatctagtcaaaggactgtttcctgattaggcattagcttagtggttgctagtctgtgttgacctttgaaaggcatgactaggctaactctgaagttgttgcttcacaccatttacaatttaaaattacctagagccttgtgggccattggaaaagactgaatgtttcactctgaaatgggagtccttggagggttttgaccagagaagagacattcaggtaatcagatcactctgccaagagatcagtccagtggcacaaaccagagggctggcagtggagatgagacagagtcaaacccggattgagtttatttggaagctgggtcagtaggatttcctggtggactgaatgtggggtgtgtaagaggaaatgagggtggcgactggaagttcctggaagggtgggttgttgcaggttagataggaaaccgtctgcagatgcagttttgggaagatgatgtttggttcggctgggtatcatgcagacaagcggagtgtcaagtctggagagacaggtctggccagggacttagatgtacagccctcagcatgtagatgccacttaactctgtgaggtggccggggagtgagtgcagagtgactgggaggagcaagactggcatgggcgagatggggcgattgcggccgtgaggcctgagcagtgcctaggagggagagggagaagcagtgtgagcatgcaggcacgcaggagtccagttgtacacggaggcgaagcactgttcagatcccgctgcagtgttaactacggtaaaggcagagttgaccactggaggagtccttcagcgtggaggccttcagcgatcttggcaagcaccaattttcgtggatgtaggagaatgggagcagaggaactggaggctgcaactgcggaaaacttttgtggggttttgctgcagagagaagcagagaaatgaagcagttgttggtggaagaaatggaatcaaaaggttttgagatagagaacagagggaagagctgttggaataaagtccaggaagagtggatggtgtctagtgagcaagtgatgtgtggccctgagtagaggcacgtacaaatcacctgtgcctgagctgcccttagaactttctgtgatcatggagatgcacgtctgtgcttcccaatattgtaacattggccgcaggttgatatggaccacttccagtgtgactagtgtgattgaggaactgcattttaaatattatgtaattgtaattaattttaatttaaatagccacacgtagctcctctataggccaggtcagagctctgataaggctggatatgggaggaaaccctggtagagggttgactgtagaggttcttttggttttggagtgaatcaggaaacagccatcagctgagtgaaggtgagggtggtggtgggtgtttgaagacaagggaaaagtgtgaaagaattgtttggagaggaaggaaagaagatgtggactggggatgtttccaatgttcgagcacgcagggctccacagttatctacatttgctgtcccttggagcaggagagaagaaaacggttgggacatattctgagcagactgtagaggtaaaatacgtagtttttttttgttttttgagatggaatctcgctctattgcccaggctggagtgcagtggcacgatcttgactcactgcaacctccatctcccaggttcaagcgattctctcacctctgcctcctgagtagttgggactacaggcacgcaccaccacacccagctgattttggtatttttagtagagccagggtttcaccatgttggcgaggctggtttcaaactcctgacctcatgtgatctgcccgccttggcctcccaaagtgctgggattacaggcatgagccactgtacctggccaaatatgtagtatttttaataggataaagcctacataattctgtccacagttcctttacttagaaattgctcatttgttcatgttaatgctatgtttattacagataacagcatacaggttttccccccccaccccgtcatgtacagctgaatcatgcagaatttgaagatcaagatgatgaagccagagttcagtatgagggttttcgacctgggatgtacgtctgcgttgagattgaaaatgttccctgtgaatttgtgtagaactttgacccccgttaccccattatcctgggtggcttgggcaacagcgagggaaatgttggatacgtgcaggtgggtccctttgctgcatatttggtgcctgaggctctgtggatttcccctccatcaatcatcttaccctctcatccccctcagatgcgtctgaagaaacatcgctggtataagaaaatcctcaagtcccgagatccaatcatattttctgtagggtggaggaggtttcagaccatcccgctctgttatatcgaagaccacaatggaagacaaaggcttctaaagtataccccacagcatgtgcatcgcggagcagccttttgggataaaatatgattacaataacttgcctattgctgagattaaaccttacaggctgcgttattttagctttgtgcttttcctttcataaaattccactcctaagatttttctcttttctgggagcagggaggtggtttggagtatatacgtaaatctatatccaaatctaaatgtccatatccagtatgttaaactagaatctaaaatttgtggtttgctatatttctttttttccttttcctttaagaccctatcactccacagggaactggtttcttggcaatacagtctgtcagtggcataatggtaactatcttggatgatttcttttacagattggttttgagaaatatatcctgaatgtggattactatgtacatgagactttaagttgaaaattactcatttttattaatataaagtaaatttccctttgcttttaatcttcgtacatccttttcagtagggtgtgggattagaggaggggaggtggaagaattataatggtacatttcctatttttgtgcatcttttgcatttatttatctaagcaagtacttaagcagtgctcaccatgtgctaagcactgtatgaggttgtgaggagccatcagagaccacccagacacaagactccctgcagctgtgctggggtagcagtctgttcactccattttcatttgaccagtcaggcagggcagggtttactggtcccatttaacagagaagaaagcagaataatgagcagatggaatcttccctggaggtccaaattttaatttcctaaacattgcaactgtatttttcttttccatttcgttccaaataaatcattatagtaaaattacattcctctgaaatcactctcaggaaagtactcaagtagccttttttttttctttcttttttttttttttttttgagacagagttgcactctgtcgtccaggctggagtgcagtggcacaatcttggctcgctgcaacctctgcctcctgggtttaagcggttctcctgcctcagcctcccgagtagctgggattacaggtgtgcaccatcatgccgagccaatttttgtatttttagtagagacaggatttccccatgttggccagactggtttcaaacttctgacctcaggtgatctacctgccttggcctcccaaagtgctgggattacaggtatgagccactgtgcccagcctcaagtcacccttgttagtttggcttaccaactttaaagttttggattgcttttgtcaagccactgggttgcaagttcagatggtctttcttgtttttcttagctaattgtaagtaaaattcactttggtaatttattgtgtcacatagaattgaagtttttctcttgctaatattattcctattttcaaattttggggttcctgttagcctgattttcggatagctgccacataagttgtccttgatctggataaatccataaaaattgtgaagaaattaaagctaactggttttccatataaaatttttaagaacacttcatttattaaggtctgtatatctatatattctcatatttataaatctccatattgtttgagaaaaggaatgaaatacctctaaaatatgggcctcatatttttagaaaagtgtttgaaatcttttataaacttcatattttgtttgctcctttatattctgtattacttaaatatgctcagaaaagcagtggtaaacagctatttaggaattgaggctgttactcctgacttccatgtgagactgccacagaactcatattgaaaatatgtcattttatccactaggttttgtttcctactttttaaatttgtgttaagaaagggaaaaaaatcacaagtttgtctaactcagtagaaaaatcgacaaagcatttgcagacaacttggcaagggtacagagaaacggatgtactgtttttcagtatttggggagggtggtttgagcagcatttattgacaatttcattagtggggatgtttctattgaaaacagggttaggaagtcataaaatgttcctgcaatataaggtaataataccaccagcgtttatcttactgttttcatgttctaagtgcatgcatctgagtaaaaggatctgggctgcagtccagtctgagagatgccagcaaaggcttcctaggccagttcagtccagtaaatccctcttcgatcttctcttccacacagacagcagtgatgagcatgcccatgaactcacatgattattttggggaaaatgaaagagttgtattctttttgaggtagtaattccactttcaggggcaaatacattttgattattttatcacccttcagtgagttgtttttgttctttaatcaaggatgtatgtttgaagtaagaagtaaagcataaagtatatgattttgtgtgtgtgtgtgtgtttttatcttgctgtacctgtagggaatgtttaattcagccttggaagtggccaaatttgaaggtgctgtgattcgaactgtcagtgggataagggggcagatcaagaaagcactctgagctccagaaggagctttccgggccagctttgaggataagctgctgatgagcggtgagtgtcttaagtagtgttcagggcagggtgttaccattcatgcttgacttctagccagtgtgacgagaggctggagtcaggtctccggagagttgagcagctccagccttagatctcccagtcttatgcggtatgcccattcgccttgtgtctgcagccccctggccacacccagtaacagttctgtgatctatgagaatagttcccttagcgacctttcccttcaaatactttgcagccaggtagagaagtttggagtgaaggttttgttctttgtttcttcgcaatatggatatgaatcttcttttgaaaatattaaagtaaattacctcttttcagatattgtcttcatgcaaacttggtatcctgtttccatcccagccttctgtaacccagtaacatctttgttgaaaccagtgggtgagaaagacacctggtcaggaacgcggaccacgggccaactcaggcttgcccatggtgtcagactaaaggcaaacaaggactctctgtataaggtactggtcgtgtgtgtgttagtggagatgaagcctgtgctctacagacagggagtcacacagacacttttctataatttcttacgtactttgaatgttcaagtataaagtctaacattaaatttgattgaacaattgtatgtttgtgggatattttggagtggaacaccaaaaaatggtaatagtggttctttctggattgaagacaaacttttcttttttaaaataaattttattttatatatttgaggttgacaacatgatcttaaaggatacatatagatagtaaactggttactatagtgaagcagattaacatagctaccatctcacatagttagatttttgtttgtgtgacaggaacagctaaaatctacttatttaacaaaaatcccaaagacaatatatttttattaactatagccctcatgatgtacactagatctctaacttgttcatcctacatgtctgctactttgtattattttaatgtacatctccccatttcctattggtcatttcctatttggcccatttttcaactgggttgtttttctgctattaagttgtaagagttctttactgatttttggatattaacactttatcacatatgtggtttgcaaatatttcttccagtctgttggttcccctttcattttgttggttgttcctttgctgtgcagaggctttttagtttgatgcagtcctccttgtttatgtttacatttgtagcctggcttgtggtgcgatatccaaaaaattattgctaaggccaatgtcaagaggctttccccctatgttttcttctaggagttttatggtttcaggtcttatttgggtctttggtcttgtatctgttttgagttgatttttgtgtatggtgtatgatcagggtccaattttattcttttgcatgcgaaaatcctattattgaagagactatcttttttaccattgtgttgtcttgtttgcccttgtcaaaaattagttgacagtatatgtttggatttatttcaaaggtctctgttctgttccattggtctatttttttgtttttatgccagcaccatactgttttgattactatagctttgtaatacaattttaaatcaagaggtgtgatgcctccaactttttctttcacagtaatccgttggctgtttgggattttttgtggttccataagagtttcaggattgttttttcttttcttttttttttttttgaggcgaagtctcactctgtcgcccaagctggagtgcagtggcataatctcggctcacggaaacctctgcctcctggattcaagcaattcttctgcctcagcctcccaggtagctgggactacaggcacatgccactatgcccggccaatttttgtagttttagtagagacagggtttcactctgttggccgggctggtctccaactcctgacctcgtgatccacccgctgcggtctcccaaagtgctggaattacaggcgtgagccactgtgcctggccaggattgttttattcggttctgtgaagaatgccatcagaactttgatgaggattgtgttaaatctgtatatttgctttgggtagcatgaacattttaacaatattaattctcctgatccataaacacgggatgtcttttcattcgttcatgtctaaatttctttcatcaatgttttatggttttcaagtgtacacatctctcaccttcttggttaaatttattcctaagtttttgtttttctttgatgctatcgtaaatgagattattttcttgattgcttcgtcagctacgttatttgtatatagaaatgcaactgatttttatatgttgagtttataccttgcagcttaactgaattgatttagtagttctcacagttttttgtggaatctttggagtttttttacgtaaaggatcttgtcatctgcaaatagagataattttacttatttaatttagttgcctttttttcctcatctgattgctcttgcaagtattctattgaataaaagtgatgaggctggccatccctatcttgtactcaatcttagtggaaaagctttagttgttccccactaactatgattagactgtgggtttttcataaatggtctttattgtgttgaggaactttccttctatacataaactattaagagttttatcaagaaacgttgctgaactttgttaaatgcttttactgcatcaattgaggtgaccatatcgttttatctttcattttgttaatgtgatatatcacattgattgatttacatattttaaatcagccttgcatgccagggataaatcccacttaaacacgatgtataatgtttttgatatgttgttgaattctatttgctaaaatttttttaggatgtttgcatcagtgtttaatttattggagaagttgacctgtagtttttgtttgtttggtgtgtgtgtgtgtgtgtgtgtgtgtgtgtgtgtgttttggtttggcttaggtattaaggtgatactggcctggtaaaatgtgtttggaattatttcctctcgctctgttttttcgaagagtttaagaagtaaactcccaggggatgggagtgactctggacatgggagtgacatgatagtgactctggaccctgcagtggtgggacacagcagcatctctgtctctgtgaggccaggcgcagcatcagcaaggaccccagaatggtggagcactactgtggcttgggccctcgggggcagggaccagtgcagcaactacttctctccctggggaggcaggtgcctgggcaactcagattctccagagctagtccagttccaaggaagcagggttctacagttgtttgtcctgaagggcaaggtaccccagttcagccaatgccgttttcctgggatatgggggtgccatgttggctcatccctggcaggtgtggctgctcagctcagccaagacactgattccctgtgaagcagggcagcgcttcagctctcatgcagtggggggtgtgactgctcagactggccaaggcactgattccctggaaagcagggcaccaagtcagctcaggctccaaggggcagggcgcaatggcagctgggaggggaggggcacagcagcatggccctgcaggtggggtgtatgctgtgatgtggacatcatttgttcccaccagccatttgaaatttcatccatttgaaatttgattccaaatgtggtggtgtgggaggtggggcctagtgggaggtatttgggtcacagggcagatcctttatgaatagattaatgccttttcatgggactggattagttaccaggagtggattgttatcagagtgagttcagcttcctagactctcgtgtttcctctcttgccatgtgagccccttgcatacacctgtttccccttccactttccctatgagatgaagcagcacaagaccctcgccagttgtgctgcccaatctcggacttttcagacacaagcagggtgagccaaataaaccttttttataaaataagttaccccgagtctcaagtattctgttacagccacactaaatggcctaagacagtgtaacagcggctcgggggtggtgggccactaggtgggtgtgatatagagcaacaaagcctgaggatggaagaagggtgcggtggcagctcaccctgggtgggacatgctcccgaagtggtccaggtccaggagggcacgttgcagcagcagctggtccatgggggtggggcacaatgtcagttccttctctgaggggagtgctggggctactgggcccctcttgcttccttatccctgcagggagacatcccctctgcttcaggctgatccctctgggggaatgggtggtgggggccagatgtttccttccctcctttatgtgaccgtcctggttttctgtgctctgctggatttctgctactccttgatgcactctggggctctcttttagtgactttcatcaaaatatagatgtttgctgctttggctgtctttgtcaggggatgagtgcaaggggctattgatcagccccttgctggcatcactccctcttaaacttttcactgggtactcttttgaactattttttcccccaccgtatacatgtattttttaaacgttaatgtgctaatttctactgaagcaatgtggatttttctgaaagttttaatgttttaataagctttttattgaaatgttaatgtccacacagaagagtgcccgaatcataagtgtgcatctagatgaactgtagcacaccaggctgccacgccctggaccaagcagtagcctcgccctgtggcctctcccaggcactgctgccccaacccacagaatagctactttcccagttcctgatgtagatttgttctgcctggttttgacttctataaaatacagcacattctgtttagcctggcttctttggttcagtattacagaacacatccatgttcttgtctatggcagacattgatttatcgtcattgttgagttccattatatgactgtgtcaccatttttccattgatgagtaaaatgatttcctatttttggctgttatcccacggccctgaacactaggtctggatatgggacttgcaggtatgcaggggcacacgcacttctgctggaggatccctgggtggggtggagactccagggcacctgtgctctgcttcagtatggagtagttggagtgtattgcttagaacaaaagagatgagacactaacactgtgtgtatattctaaatcatatatcagtgaagaaatgtgatgtttgcaacatcttctctggggatgctaaccccctaagtcattattaccatgcatgtaagcacctcacctagatctgcactccatctagcagtgagaaattccaccataatctacacaccataatatcatcaatgtgtctagaagtcagatcctctatgtgtgaaccaagacaatgcctggcaaacaagacagctgggctctcaggtctctgcaccatggggaggtgtgtaaggccattcttgaattactataaagaaatctctgagactggatgatttacaaagaaatttacaaagaaatgttgaattgactcacagttctgtgggctgtacaggaagcttggtgctggcatctgctccttttctgggatgcctcaaggagtttttactcacggcagaagatgaagtaggagcaggcatctcacatggcagaacaggagcaggatagagagtgggtaggaaaggtgtcacaaatttgaacaaccaaatcccatgaaaactcactatcataaggtgaaaaccaacccaagaaggatactctctcatgacccaagtacctcccacaaggtcccacttccaaccttgtgaattacatttcaacatgagatttagtttagcatccaaactataccattattcccctggtctctaaagtctcatgttcttctcacatggcaaaatacaataatgtcttcctaacaatccccaaaactcttaactcattccagcatcaactcagtcgaagtccacagttcagagtctcatttgagttaaggcaagtccctttcacctataggccagtaaaataaaaaacaagttatttacttccaaaatacactggtagtacagacattgggtaaatattcccattccaagagagaaaaaactgccataaaaaaagggctacagatgtcatggaagtttgaaaccccgcagggcattcattaaatgttaaagctccaaaataatctttttttgactccgtctcccacatccagggcacactgatgtaaagggcaagctaccaaggctgagggcagttctacccatttggctacgcagggttcggcccctgtggctactctcataggctgttaagtgcctgcagcttttccaggtgtaggatacaatctgccagtagatctaccattctggaatacagaggacagtgacctccttcccacacctccactaggcagtgccccagtggggactcggtctggggcctccaaccccacatttcccctccacactgacctagtagaggttctgtgggagggttctgcccccacaacaggcttctgccttagcacccaggcttttccatacatcctctgaaatctaggtggaggttgttgaggctccagcactcttgcattctgtactcctgcaggtttaacaccacatggaagcttccaaggcttaacatggcttttgctccccaaaactgtggcatagcattatctggagcctcttgagccaaggctggagctgaatcagccatgaggttgcacaggactgtggggccctaggccagacccagcaagccattcagttcacctaggcctcaggacctgtaatgtgagaggctgcctcagagatatctgaaatgcctttgaggtctttttcccattgtcttggctatcaacacttggctcctctttagttacgcaaatacctctagcaagtgattgtttcgcagcccacttggattcttttcaggaagaggggatgttattttctgccacatagtcaagctgaaaatttttcaatcttctatgctctgctttccttttaaatataaattccaaattaaagtcatttctttgatctcacatctgagtataggctgtagacacagccaggccacctcttgaactctttctgcctagaaatttcttctgccagatactctaaatgattgttctgaagttccaacttccacagattcctagaacatgaatagaattcagccaaactctttcctaaggcataacatgggagatacttgccccagttcccaataagttactcactttccgtctgagatgttgacagcctatgcttcattgttcctaacaccatcagcattttgatcacaaccatttaaccagtctctataaagtctgaagcattttctaatcttcctgttgtgaacccccaaaattggacacaagtctcagttaactcagaaagcttattttgccaaggttgaggaggcacatctgtgacacagcctcaggagatcctgatgacatgtgtccaagatggtaggggtacagcttggttttatgcattttaggcagacatgagacatcaatcaacatgtgtaagatgtacatcagttcagtctggaaaggtggaacagctccaggtgaaggcaggacaacttgaagtggggaaggggcttccagtcttagatagataagagacacatggttgcattcttttgagcttctgatgagcctctccaaaaggaggcaatcagatatgtgtttctctcagtgagcagaggggagactttcaatagactgggaggcaggtttgctctaagcagttcccaggttgagtggggtcccaagatttgttttcctttcacactgtcttctcctgagccccccaaacccttccaacctctggccatgactgagttccacagctgcttttgtactatcaggtatcttttagccatactttatttaccaattatctgtgttaggacattgttgcattgctacaaagaaatttgttgggaaatttacaaacaaaagaggttgaattggcttatggttctgcaggctgtacaagagtcatggtgcctccatttgcttggcttctgaggacacctcaaggggattttacttggtggaacatgaagtgggagcagacatctctcatggcagggtgggagcaagaaagagagtaaggcaggaggttccacacatctaaacaatcagatcttgcaagaactcactcactgtcatgaggacagcaccaagcctcgcggaatccgcttcaatgacccaaccacctcccaccaggtgccacatgcaacattggggattacgtttcaacaggagattgagagaggacacacatccacactatatcaggaggtgtgtgccttgcaaccatcaggggatgctgcaggactgccctatggtccctacacagctgcttagtaagaaccattcactccaaggaacctgtgccctgtgctcaatgatggggactcaggagctgtgtcctctctggcctggcagagtcccctaagcagagacctgtgtatggtctcggcaggtgcttcctcccagggccctcccgagggggaaaccaaaccttcctcctcctcagtctggagtgtgagctaagcttcagctccagggctcagggaggggctgggcagtccttggatggaaacatatttgcatgagcagcccctcctctggcagaggatggagaagaagaggagacctggggcagctcaggcccactgttagggctcaggggctgtgtccaccatggcctggactcttctccttctcgtgctcctctctcactgcacaggtagggaaagtccttataaactgagtctcagtgtccaacctacaccatcccctgtggctcagacctacaagaagctttaccctgggaactgccttatcacccatgatgtctgtgttttcaggttccctctcccagcctgtgctgactcagccatcttcccattctgcatcttctggagcatcagtcagactcacctgcatgctgagcagtggcttcagtgttggggacttctggataaggtggtaccaacaaaagccagggaaccctccccggtatctcctgtactaccactcagactccaataagggccaaggctctggagttcccagccgcttctctggatccaacgatgcatcagccaatgcagggattctgcgtatctctgggctccagcctgaggatgaggctgactattactgtggtacatggcacagcaactctaagactcacacagtgctccagacccatgaggaagtaagacaaaaccctcccctctactctcctggtctagtgaaatcacccctgctggtggctctgaccaaatctagctcagggggtgacatctgttgtctcatcgacagcactggagctcccacggagaagtaggtctaacaaagtcctaccttgctcgcatttcacaggcagacatcccttgctcaggggtaaaatctctcagtgttgacattgaagaaggcaagagggctgggttggggttcatctcagctcagagtctagaagtgactcagagatgctgctggtctgagagttttaatatgagccttgggatacaatacagggatgcagatgggaattgtattctctatgtcagtaacgaaccatcagtaattgaaaagtcaatacattgagaatagcataaagcatgaaatactttaggataagtatgacaaaaattgttgttttacacactagaagtcctaaaacattgtttagacgcaggtcttaaagaagacctgagtaaatgcacagataatccttttttttttttttttttttttgaggcagagtttcactcttgttgcccaggctggagtgcaatggcatgatcttggatctcggctcaccacaacctccacctcctgggttcaagcgattctcctgcctcagcctcccgagtagctgggattacaggcatgtgccaccacgcctggctaatttttgtatttttagtagagatggggtttctccatgttggtcaggctggtctcgaacacctgatctccggtgatctgcccgcctcggcctcctgaagtgctgggattactggcgtgagccaatgcgcccagcccagataacccttttttttttttttttttttgagcaggagtctcgctctgtcgcccaggatgcagtgcagtggcgcgatcttggctcactgcaacctctgcctcccggttgaagtgattctcctgcctcagcctccctagtagctgggactacaggcatgtgacaccatgcccggctaatttttttttttccttgtggcaacggggtttcaccgtgtttggtcttgatctcttgaccttgtgatccgcccaccttggcctctcaaactgctgggattacaggcatgagccaccgtgcctggccccagataaccctttttatgtgagagtgtagagaatgttgctgcagctggtgtgggatgggggatggctgggttgagactgtgttgtcacctgcagtgtacacctgaggtgacatggttctgaacatcactttccccattgaaggcccgagtgacctatcacttgcttctcaaaattcaggaactaggtgactctaggagagtgcacaggaagctttctgcatattctttcaagagatttcgaggtcactgactcttttttcaagacttaaacacaaaatccacatccatcattcttgcgtaaagagaccattcttttttttttgagatggagtctcgctctgttgcccaagctggagtgcagtggcatgatctcggctcactgcaagctctgtcttctgggttcatgcccttctcctgcctcagcctcccaagtagctgggactacaggcacccgccgccatgcccggctaattttttgtattttttagtggagatggggtttcaacatgttggccagaatggtcttgatctcttgacctcgtgatccacccgccttggcctcccaaagtgctgggattacaggtgtgagccactgcacccggcccaagatggggtttcatcatgttgacctggctggtctcaaactcccaacctcaagtgatccactcacttcagcctcccaaagtgctgggatgacaggcgtgagccacagtgcccggcctagtacattgtttaaatggtgcatgtaaaacctcatggtactacaactgcctggtgacagactcaccagagtaaataactatcctgctgttctccaaccacatgggattccccaaacaaagatttgttgagtccaagatgcatcatgccagaactcttgcagtcatacacataatttgtttcattttaataaatacggttatcttttttcttcagtttattgtttttaatgtatcatcttctaggtttcattacacatcaaagatgaataatttctctcatctttaggacatgctgaaaacactcattagtgattttgaacagtattatttcctaaacatcctagttggaatggttgatcctaaaagctaccatgtgtcaggctcacctgagtgcagactgtggtctaaacaagctaaagttttaattcttccatcttcaaatacggagcatatttgcttgttttgctctttagcaaaacactgcaaagtcattcgccaggatctcctgcagactggcattcagtgatggagaacagactcctaggtgagatccctggtcacaggatccagatgactatgactgcaagtctggaaaagaagagacagaacaaagatttaccagcataaccctctgagaatgtgccccagccatcctggagggaagagctccctattgacccagcactgcagaatccacagaggaaggacagctctggccaccagggagcagccacacgacaagagaggacccggtgtccccacaggtgaggaaatgagtccatggggctggtcagtgctctcgatttcattctgccataacaggactttgtgtagtcaccacctgagtcctatacagtgaacagccaaggagacatggacagattcacccctgaggaacccagtagaatgtgaagtctgccctgaggtcacgaagaaaagactcggggggctgcctggcctggccctgatggagggggccatggacagaacaacggggaggcaggggtgtctctgagaggctctggtcaccttgtcatacaatggtggtgtacaatgtcgcaccatggacactagggggcgcctgcgcaccattcctgagaagactgggtgtgatgagagcaggaccagcgccacctgtcctgcttggtgccctatgcttagggctcacagatgtcaactctccaccccctgggaccacacagccccacccctggcactctctgacatcctcaggcagaggagcttgacccagggcccagggtgggatcagaaagctggagggtctgatttgcatggatggaccctccttctctcagagtataaagaggggcagggagagacttggggaagctctgcttcagctgtgagcgcagaaggcaggactcgggacaatcttcatcatgacctgctcccctctcctcctcacccttctcattcactgcacaggtgcccagacacagggtcaggggaggggtccaggaagcccatgaggccctgctttctccttctctctctagaccaagaatcaccgtgtctgtgtctctcctgcttccagggtcctgggcccagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctggcacagtgctccagcccaatggggaactgagacaagaacccccttcttcctcccccaggagggtgagtgccgccagctgctgctcacgcctgacctgtagcttctgctgctgcaggttctcccatgggccacggggcagccagggccctgcctaggagtggaggctccaccacttttgtcctcagagtcaggaacagggactccaggaatgagaatatcctgctcctgcagcttgggacacagggtctctgcactgacatcctgggctgaggtggcaggtccagctgtgtcttcacagtccttcctgtgcctgcccatggtgtggggagggagggagtggggaagggggtgtgggcctttgagcttcactagagacctgagggagcagaggtgctccccaagacctggactccttccctcaccctcctcccatcactctcctcactgtagctatggccaggtgagggctcagggctacttgaggaccttgctcagcccagggcctccatcccaggcattgtttccaaactctgtaagggctgtctctgaatctgtagaaacagttatttctatgtgcccaggactgggttagagggcaccaaccccaccccttgcaaactgctcctcacctcttagcgccccagtgaggagaagaaagagttagaaatcaggaatctactcagggctcccctctctcccctttcccagcctcccctggctttctctttctacagaaacaccaaggaggcagccaccaaggacgaggggaggcccaggcattataccaggcagcggagccagccagtccccccagatggtggagggaggtggtggaggtgtctgggaccagaaaatagtgaggaccctcttactgaagtgaggacgggtggcataaactgaggcccagatggtggaccagatctcctgagccatctactcatttcttcgtgtgttccagtttgggtaagaataggctaaaaaaaaaaaaaaaaggctttgaagaggttcctttcctcagataagaattcgtagaggattattgcccactcaggcattgaggggaggctgagcctcactctcaggccaatagaactgggggctttcaagggaatttgattgtactgagctcccagactctgacatctaagatttttgccctcgtagccgaacccagcactgataccaaaatggatgaaggctgatagataagcctagaatattctagctggcaccatctcgtggaaaagagaatcaagttagaatattgatgtgataaggtggcatcgcacagtgaggggaggagagcttgcatgggggagggtagaggagccactagagggctggacaaggaggagacagtctgaggtaagtttgtgaggaaaactccagatgcttcagagaagatggacaaggaggtaggcagtgtgaaggccatgggaccagctctagtcaccgggagagagtggtcagattcagcaccagtgtctggggaggaggtactgaagcctgggtgaggggagaggctcaaggctggccttaggacctgagtggggcacagtgatcacactgctggggggtccttcaagtgcaagggggctgcaggaaggcttgagctcattgtcacaatgaaaacttagacaacagctccccagccttgttcaaaggtgtcacaggactttttcctctccacatggcaacgtggagaagaaaacttatctctgagatatataagatgttagttctccataacctctcttgtcccctggctgaattcctatttggaaacaaaatgactctccagttttatatatgacatcctcacaaaaaaaaagttccagaatgagaaagatctgccctccctgacccactggtgaggaatctcagccttcaggacaaccagactaaatcattcatgccatctcccatgacagcatcatgtggaccagggagcctaccttatgggtttgggccacacactgcctgtccctagcattgcagctggggacacttacatgctgaactcatggctgggagatctgaggtccagacatgacaggaaaaggaaaaagaccaggagctctgcctaagtagcccccctgtgtgaatcactctaccctccaccctcatcttcagttcgtgatgggtattgtcttgtgaaaactgaaagctgggctgggacacaggcaagagagtctctgactcacaaatctccatcgtgggctctctggcctttctgatattcttttcacacatcaattctgggccaagacacatccatgctcatcaagaaggcattgataggagaatcaggtagcctccagagagacaggaagcagataaacaccctcatgttggcctcctaagcccagaggagaaaaaaaaaagttggaggggaagaagttcaagaagccacactagaagccactgattaccatcacctcggcacctgtcctccatctgcccctctttcaagtgaggaccagactcaggggacagcacctgcacctccccctctgtccatgcactgtgtagggagcctccttctgctctcatctcaaggtggctgctccgccaggtcagccgtatcactgctgagagtcttccctgggtcctggtcacagggtctgggatcagcagcaacctggctttgattcagctctgaccctgccccttcaggacacaaagcccattattaaagggataactgaactctcctagttcactcaaccttagattttccttctcagtgtccttctagaaagtgccgcctctactaaatgatttcatgttatttcctcaggtctagagctatttgatttccaaaattctatactcttctgttctcattcccggtcatggctcattttccctcagcagctaatgatgctaatcatgtatctaccccccattgtcacaaaaaagagagatggaagagttccttagataaatacagggttagcaaagaaaagtttcattatctcttaagaattactccaagatctggccaggcgtggtggctcatgcctgtaatcctagcactttgggagtccaaggtagacaggtcacgagatcaggagatcgagaccatcctggctaacatggtgaaaacccatctctactaaaaatacaaaaaattagccaggcatggtggtgggcacttgtagtcccagctactgaggaggctgaggcaggagaacagcgtgaacccgggaagtggagcttgcagggagccgagatcatgtctctgcactccagcctgggcaacagagcgagactccgtctcaaaaaaaaaaaaataaagaattactccaagatctaagaaaattaattccagttcttcaagagtttactcctcagaaacaacagcatgaatacattaggtagtgaatgttcttggtcttctcaatgaataacgtctgaaaggttcagagtatatgtttcaaaaaggtaagtgcataactttcaaaaaaatgtagtattaacatgtcaacaattttaattggtatatatatttctgaaaaaaaagcagtatgatggtaaaagaaatgtaaaaaagcctttgtaaaacccagtgcttacagtccaccaggatagcacctgtgaagcaaatttcctttgctgaagatacaccgccttttagaataatagcaagatagtttgaatttgtcttcttctctcacagcaatctaaaaattaacttaatcccatttatatgacatatctagaaatattcctgtacatgtggacattcccatcgcacacctcccatccaggctgtcctaaagtggcatctcctcttcttctgctcatgttctccccctctcctcacctctcctgctgacacgtggctcctccctgccttcctctccagtagccccagcagatcaggcccaaccagtgaacaagctcctggacttcttggatttctgaggacttgccctgccagggtgtctttctcaatcacaatctctccttcccgggagtccaattctcctagatcctgttatttatctaatgttatacatctgtatctacttggtggacttccctacatcttcacccgaaccccaggaatcttcaggtcatgcccatatgaccttagttctcctggagtcccttcttccttcttcccctgtgatcccaccaagtggagatctcttctcagaccctggagtgcagcagggacttctctggtctctgccccagggattaagggggtggaattgaggactcctgtgcccttcctatgcctgtgttttcatcagggtcagctgcacaaggtagggattcccactctcagagtatgaagaggggcagggagagatttggggaagctctgcttcagctgtgggcacaggaggcagcactcaggacaatctccagcatggcctggtcttctctcctcctcactctcctcgctcactgcacaggtgactggatgcagatcgaggggagggtccctgggaagcctatggattcttgctttctcctcttgtctctagaagcagaatcatgatgcctgtgtctctcccacttccagggtcctgggcccagtctgtgctgacgcagccgccctcagtgtctggggccccagggcagagggtcaccatctcctgcactgggagcagctccaacattggggcgggttatgttgtacattggtaccagcagcttccaggaacagcccccaaactcctcatctatggtaacagcaatcggccctcaggggtccctgaccaattctctggctccaagtctggcacctcagcctccctggccatcactggactccagtctgaggatgaggctgattattactgcaaagcatgggataacagcctgaatgctcacacagtgctccaggcccagggggaggtgagagaagaacccccttcctcctctaccaggagggtgagcgctcagctgctactgctcaggcgtggcctgtggcttctgctgctgcagcttcccccatggtccaggggcatccagggccctgcctcagagtagaggcttctctttttttctgttctgagaatcatgcacagcagctccttcctaggaacagggcctccagggaccagaacatccatctctttgtaccttgggacacagggtctctgcagtgaagtcctgggctgaggtgtcaggtccaactgtcatcacaaacctgatgcagaacctgtgtctccatcaacctcatttcctgatttctggaagttccgactgttggctttctgtccctgctcctcagggtgaatcgcttggcttctttcctccccagcctactctttttaataaaaccctttccaaggaggaataatgtccatacgagaaaacacctatatttataatataccatgacacccattttggcatgtttctggatccttgaaagcatcaccaccaccgagctatgcaagctgtgaccaaccccagcagctcctcatgaccctttgtcatctccctttctaccccaatgccctcccgggaagccacagatcctcctctgtcattagtgtttggtttccattttctggaaggtatcagtgttcacaaacattctcttgccatttgttgaggcttctttcactccgcacactttttgagattctccctgttgttgctgaatgacatctcatcccataaagggctcatcagtacctttgagggcccctagccattttgcctttcatgcccattcctgcatttgtatatacacatatagaatccagggtagcctatattccttttaatctgaattttaaaaaatcaatacattttctggggcccctaacagcgtcgagtcctgtaggcatttgatcttctctctccagtgatgctcagccctacttgcatctcatgcgattatactcacttctcgccattattcaacaattttgttttattctcttggttttaaataggcaatacacaaacaagatgccacatgagaactatggaaaccacttccccctcctacatcctgtctcctggcctgttggtttctctcagctgaagtgaccaggaatgcttacatttatgttccctcccagccaggatctgtgtgtagaaacaagggggtctgtctgtgtctgtgtgggcaaccacattatgttttctttagtaccactacaaccttactattgacaaacaactttttaattcctgagactgtgacttcatgtaatcctgacagtagcccgattattgcttttgaggcagtggtcctgattggagaggaactgtttgtgacctggggatggcgttctctaatttatcaaatgtaaacactggaggtcagttaaatttgaattcggtaaaacaatgatgaagaatcaataggtaggctgggcgccgtggctcacaccttaaccctggcacttttggaagccaaggttgatggattgcttcaggccaggagttcgagacaagtctgacccacgtggtgaaaccccgtatctcctaaaaatacaaaaattagctgggcctcatgacatatacctgtaatcccagtgactcaggaggttgaggcatgagaatcacttgaacccaagaggcagaggttgcagtgagctgagaccgggccactaactccaggtggagtaacagagtgacactctgactcaaaaaaaaataccaaaaaaaaaaaaaaagagtcagtatgtgtatcccccagacaatattgtgtatttaaatataaacataactgggtgccctttaatttatctggcaactccacacagtgtcacaacctggaagaagcatagctggggcagtcatccccttactgatgctgggtctaggggcttaactacaaagacagagctttgctagcaaagatacactcaagtgagcacatcagtgagcatgaaatgcatgtgatataattcccaatgaatgatgcctcctcacttctctaattattctttctattatccttcaagtctgcagattcagggcctccccagggattgcttcagcctgagcgctagacaagtgatctcatgtcctgtcacacccagatgcatggggctactctgtccccacacagaggggcttcagcctggggtgcataagtaacatgtgagagagagaagagctcagcctggctctgcttatatctagtgagagaccaacttcgggttcatttgatgctggaggctggtgagctgagagcagaggagagaccaagccttagagtgcagggctttcaggagagaaattgggaacctggaaatgggccacactcttcagtgaggaagaagcaggcagctctaggcacagccctgcattcctagtggcttccccttcatcaagcttgactccctgctttgatgtctgtcagggaatctacttcagcaaggtgaagatcccagggctttactaaaaatagcagtagaccaggcaggtatgtcatggttcaagagttctgtgcacagaaataaatacagatgcatattcacaagggccctcacagttgtctcttttggagtggaagagatgaagaaaggcagggagaaattgaaagactcagtcggtctgggcctggggcagcactggatgctgtggacttatccctgaagggtctgcaggtgaccacagccaggaagccagcccctgctatgaccctgtgtcatctgctcactgctcactgagctcagcagctgtgtcctcacaggaaactgggtgcagccagcttggccttctccaccccacctggaaaatgtgggcaggtgactgtcagcattgagatcctatgaaggggctgggagacaagggaagagggctgatttgcatgaagcaatcattccacacccttatctttaaactatatcccattaatggaagctctggggccatccaaacctgatcaatctaagaggggttatcagctggaggtggtcagagtgaggaagaaactggcttccttgaaagactcatcaacacagccaccaactctgggacaaatggggtgactccctataactgtcacccgatattagccacaggagcctgagcctagtcccctcaccttattgcttctgattctggtccagtcccctgttgtccctggacccttgcctatgtctgagtccagggtggcaggggtagccccatctcagtcaacatctatagagaggtaagagctactacggcttcaagcagagtccacagttttacccatgagggcctcttttgctcccccaccctgtcacacaggtgactactgctgtgggtctggtggagtggcccctggcccctgaaggacacaaggtattccttcctctctaacaccaggcatatagtggagaaggtatgggtgggtatagaacagattggcttttctagatgcaaatcggtaagaccctggctacagaaaaattatttcacaaaaccccacaccctttcgtgacaaaaacactcagtgaattatgaatagaaggaaattacctcaacatagtaaaccctatgtatgaaactcccacagctaacatcacgtgcaatctgaaagactgaagatatttcctgtaacttcaggaacaaagcaaggatgcgcactttcaccacttctattccaaatagtattggaagacctagccagagcaattagccaagaaaaagaaataaacagaaaagaaattagaaatgaaaaagtaaaataatctctgttttcagatgacctaatcttatatgtagaaaatccataaaacttccaccaaaatagcaaactcttctcagctaagggaccatgttctaacccaatgaagggaagctaagaaccttgataaaaggttacaggaacagctaaatggaataatcagtttagagagaaacataaataacctgatggagctgaaaaacacagcagaagaacttcatgaagcatacacaagtatcaatagctgaaccaaaccagtggaagaaagtatatcagagactgaagatcaacttactgaaatgggtgtgaagacaagataaggcaaaaaagcaggaaaagaaatgaacaaagcctccaagaaatatgggactatgtgaaacgaccaaacttacaattgattggtgtacctgaaagtgacggggagaatggaaccacgttggaaaacacacttcaggatattatccaggagaaattccccaacctggcaagacaggccaacattcaaattcaggaaatacaaggaagatcactaagatactcctcgagaagagcaagccaaagacacataaccgtcagattcaccaaggttgaaatgaaggaaacaatgttaagtggatccagagagaaaggtcaggttacctacaaagggaagcccatcagactaacagcagatctctctgcggaaaccctacaagccagaagagagtgggagccaatattcaacttcttaaagaaaagaattttcagtccagaattttatatccagccaaactaagctacataagtgaaggagaaataaaattctttacagataagcaaatgctgaggtattttatcaccaccaggcctaccttacaagagctcctgaaggaagcactaaatatggaaaggaaaaactgctaccagccactgcaaaaacacaccaaaatataaagaccaatgatgctatgaagaaactgcatcaagtaatgtgcaaaataaccagttagcatcatgatgacaggataaaattcccacataataatattaattttaaatgtaaatgggccaaatgccccaattaaaagacacagactggcaaattgggtaaagagtcaagacccattggtgtggtatattcaggagacccatctcacatcaaaagacacacataggctcaaaataaaggaatggaggaatatttaccaagcaaatggaaagaaaaaaaaaagctggggtcgcaatcctagtctctgataaaacagactttaaacaaacaaggatcaaaaaagacaaagaaaggcattacataatggtaaagggatcaatgcaacaagaagaactaactatgctaaatatatatgcacccaatacaggagcacccagtttcataaaacaagttcttagagacctacaaagagacttaaactcccagatgataatactgggagactttgacactccactgtcaatattaaatcaatgagacagaaaatgaacaaggatatcccatccttagaaaaccccatcgtctcagccccaaaactccttaagctgatgagcaacttcagtaaagtctcaggatacaaaatcaatgtgaaaaattcacaagtatttctatgcatcagcaatagacaagcagaaagccaaatcatgagtgaactcccattcccaattgctacgaagaaaataaaatacctaggaatacaacttacaagggatgtgaaggacctcttcaaggagaactacaaaccattgctcaaggaaataagagagaacatgaactcagctctggaccaagtggacctatagatatctacagaaaactttaccccaaatcaatagaatatacattcttctcagtgccacataacatatattctaaaattgaccacataattggaagtaaaacatccttagcaaatgcgaaagaatggaaatcataacaaacagtctttcagactaccgagcaatcaaattagaactcaggatgaagaaacttactcaaaaccacacaactacacggaaattgaacaacctgctcctgaatgactactgggtaaataatgaaattaaggcagaaataaagaagttatttgaagccaatgagaacaaagagacaatgtaccagaatctctgggacacagctagaacagtgtgtagagggaaatttatagcactaaatgccacagcagaaagtgggaaagatctaaaattgacaccctaacatcacaattaaaggaagtttagaagcaagagcaaataaattcaaaagctagcagaagacaagaaataactaagatcggagcagagctgaaagagatagagacgtgaataacccttcaaaaaaatcaatgaatccaggagctggttttttgaaaagattaacaatctagatagaccactagctagactaataaataagaaagaagaatcaaatagatacaataaaaaagataaaggggatatcactactgatctcccagaaatgcgaactaccatcagagaatactacaaacacctctatgcaaataaactagaaaatctagaagaaaggatagattcctggacacatacaccctcccaagactaaatcaggaagaagctgaatccctgaatagaccaataacaagttctggtattgtggcagtaattaatagcctaccaaccaaaaaaagcccaggaccagacagattcacagctgaattataccagaggtacaaagaggagctgataccattccttctgaaaccattccaaagaatagaaaaagagagactcctctctaactcattttgtgaagctagcatcatcctgatatcaaaatctggcagagacacaacaaaaacagaaaattccgggccaatatctttgatgaacattgatgcgaaaatcctcaataaaatactggcaaactgaatccagcagcacatcaaaaaacttacccaccacaatcaagtcggcttcatcgctgggatgcaagtctggttcaacatacacaaatcaataaatgtaatccatcgcataaacagaactaaagacaaaaaccacatgattatctcaatagatgcagaaaagccctttgataaaattcaacatcccttcatgctaaaacctctcaataaactaagtgttgatggaacatatctcaaaataataagaggaatttatgaaaaacccatagccaacatcatactgaatgggcaaaagctggaagcattcactttgaaaaccaccacaagacaaggatgccctctctgaacacttctgttcaacatagcattggaagttctagccagggcaatcaggcaagagaaataaagcgtatttgaataggaagagaggaagtcaaattgtctctgtttgcagacgatatgactgtatagttagaaaacccaatcatctcagcccaaaaactccttaagctgataagcaactccagcaaagtcccaggatacaaaatcaatgtgcaaaaatcgcaagcattcctacacaccagaaatagacaagcagagagccaaatcatgagtgaaccctcattcacaattgctacaaagaaaataaaatgcctaggagtacaacttacagggacttgaaggacctcttcaaggagaactatacactactgctgaaggaaataagaaaggacacaaaggaatgaaaaaacattccattctcatggataggaagaatcaatatcgtgaaaatggccatattgcccaaagtaatctatagattcaatgctattcccatgaagacaccactgactttttctgcagaatagaaaaaagctactttaaatttcatatggaaccaagaaagaacctggataaccaagacaattctaaacaaaaagaacaaagctggaggcatcacaccacctgacttcaaattacactaccaggcaacagtaaccaaaacagcatggtactggtaccaaagcagataaatagatcaatggtacagagcagagacctgagaaataacaccacacatctacaaccatctgatctttgacaaacttgacaaaaacaagcaatggggaaaggattccctatttgataagtggtgctgggaaaactggtagccatagacagaaaacagaaactggaccgcttccttacaccgtatacaaaaattaactcaaaacggattaaagacttaaatgtaaaacccaaaaccataaaaaccctggaagaaaacctaggcaattccattcaggacacaggtgtgggcaaatactttatgatgaaaataccaaaagcgatggcaacaaaagctaaattgaaaatgggatctaatcaaactaaagaacttcggcagagtaaaagaaacaatcatcagagtaaacaggcaacctacagaatgggagaaaatttttgcaagctacccatttgacaaaggtctaatatttagaatctacaaggaacttaaacaaatttacaagaaataaacaaacaaccccatcaaaaaatggactaaggatatgaacaaacacttctcaaaagaagacatgtatgtggccaacaaacatatgaaaaacagcgcatcatcactggtcattagagaaatgcaaatcaaaaccacagtgaggtaccatctcacaccagttagaatggcaattattaaacagtcgggaaacaacagatgttggtgaggctgcggagaaattggaatgcttttacactgtcagtgggaatgtaaattagttcaaccattgtggaagacagtgtggcaattcctcaaggatctagaaccagaaataccatttgagaccagtaatcccattcctgggtatatacccaaaggattataaatcattctaccataaagacacatggacacatatgtttattgcagcactctatgcagtagcaacgacttggaaccaatccaaatggccatcaatgacagactgaatatagaaaatgtggcatatatacactgtggaatactatgcagccataaaaaagaatgagttcatgttctttgcagggacatagatgaagctggaagccatcattctcagcaaagtaacactgaaacagaaaatcaaacactgcatgttcatactcataagtgggagttgaagaatgagaacacgtggacacagggagggaaacatcgtataccagggcctgtccgggggggctgggggtcaaggggagggagagcattaggatgaatacctcatgcataccgggattaaaacctagatgacaggttgataggtgtagtaaaccaccatgtcacatatatacctctgtaacaaacctgcgggttctgcacacatgtatcccagaacttaaagtaaaataaacaaacaaataaataaataaataaataaataaataaaataagtcccaccaaaacaaaaactgttagaactattaaatacatttggtaatatttcagaatacaaaatcaacacataaaaccatctaatggacagccatgatggctcatacctgtaatcccagctcttggggaagctgaggtgaaaggattggttaggatcaagagagttcaataccagcgtgggaaatgaagtgagaccctgtctcaaaaacaaacaaacaaacgaacaagcaaacaaacagggttcttatatttctatacttaatcaaccaaacaggaaacaagaagacaggacacaacgcaaaatgaaattaagaaaacaattcaatttacaatagcatcagaaagaataaaatacttaagaatcaagaaggggactcttctatactgaaaactataaaacattgctaaaagaaattaaagaatacacaaataaatggaaagaaacattgctaaaagaaattaaagaatacacaaataaatggaaagaaaacatttgttcatgaattgaaaaacttgatattgttaagaaatcaatacaaaccaaaagaaatctacagattcatttcaatctctattaaaattccaataatttttttgcaaaagtagaaaaaattaattctaaaatttacatagactatcacaggactccaaatagccaaaatgatcttctaaaagaagaacagtgttggagatttcacacttcctgatttcaaaacatactacagagctacaccaatcaaagcagagtggtacagatagacagacacagagacaaatagaatagaattgagcacccagaaagaatctcttagttatatgatcaaatgattttaaataagggtagcaagaccattgagtggggaaaggacagactccataaaaaatgtttttgagaaaactggatatccacatgcaatgtggaaatggataaaagacccaaatggaaaagccataactgtaaaaatcttaatagaaaacactaggaagaagtttaacaacattgggtttggaaatgatttcttgtatttgacgccaaaagcacaagaaaaaaaaaagaaaaagaatatagataaattggatttcatcaaattgtaaaatttatgtgcaacaaaggactctatcaacagagggaaaatgcaaatcatggagtcagaaaatattttgcaaacattgtatctggtaaggtgtccaggatatagaaagaactcctacaactcaacaggaataaaaaaatagaaacaatctgaataaaacatgggcccaagacttgaatagatatttctccgaagaagatcaataaatggccaataagcacatgaaaagatgtttagcatcactaatcattagagaaatccaaatcaaaccacaataatacacaacttcacacccagtaggatggcgttaccaaaataatagaaaataacaagttctggcaaagatgagtagaaattgtggagaaactataaaatgatgcatccactgtggaagccttatggcagttcctcaaaaaattaaacatagaattaccattttaacagaattttcacttctgggtatgtgcctaaaagaattcagagcagggtctcaaagagaaatttgtacacccttgttcatagcagcattgttcacaatagctaaaaggtagaggcagcccaagtgtccatctaatggataaatgggatatagtatacacacacaagggaatagtattcagccttaaagagagtgttctggcccatgctgtggcacagataaacctgaaagacatcatgccagcagaaataagctggcttcaaaagaacaaaaattgtttcattacccttatatgaggtacctagagtagtaaaagctaccgtgacaagaagtataatgaagtttcccaggtccttggggtggagagtagggggagaatggacagttatttgttttttgtttagtttagttttgctttgttttgtttttgagactgagtctccctctgtcacccagtctggagtgcagtggcacaatcttggctcactgcaacctctgcctcctgggttcaagcgattctcatgcctcagcctcccaagtagctgggattacaggcatgcaccaccatgttcagctaacttttggtattttttagtagagatggggttttaccattttgctcaggctaatcttgaactcctgggctccagtgatccaccgaccttggcctctcaaagtgctgaaatcaaggaagtgagccaccacaccgagccgggcagttcttgtttaatggttgcgaagttttagtttgggaagatgaaaaatttctgaagatgaatggtagcagtgtgattgtacaagttgatttacttagtgacactgaagtgtacacatgaaatggtgaaggtaacaaattttatgtttgaatattttaccacagtcaaaaagaggaagatttatatttggcaccattgctctacttccaagaacagtagaaagatacagtagtaggagagtgtgcacaagtatccaggacgtctttcattttttgccagccctgcagcatcctaacaatccaagagagcaggaggtgtctcattacaggggactcagaataatgtgaagaaatctggggcggggtgggggcataatgatagcacacaggtgccggacccagtccaggagtggccacaaatgcaagggctgcagaagagggggagatgaagctggtggcagtggtagcagctgcttcagctggaaaggggcatctgttgctttccaaagtggttcacagttgaaatatctggcatagatacttcatcctgcctacctttcatgactaactatattttcattgcaatatatgcagtcatagtgagaatacctatttcctccagatacaagcaaacgtgaaggaaatgtgctttagtgctttggccaacttgacatggcagtcacaaaaagaggatgaatatccaaagacaaccttttccaaagataaggttattataccgtttattgtaaatactggaagtgcacaacaatcattcagacacctgggaaaatgacttgaccaaatacagttgtgaaaacaatgagtaaagaaagtgatatattcttggtaaaagaaccactggatctagtgagtaaagaaccaaaaggagatgaccctagattggaacttttagaccaggaccttggtaacattggtcctgtttatgcaacaaaaacaaagcaataccttgtctaccagtgagaatctgaatgagggaacagcaacaggaagcagcagaaaaaaggaaaagaagctcagtgcaaacagctgaatggggagatcacagggaccaccaagaaggcccagggttttctgctcagtgccttccctctcatacaccttagagcacccactgaacaaagataactaccagtatattctagctgagcctgatccccacgcccttggtcctcagaagcttgaacttgactgctgggcaaaattccttattcctggagacctctacagaggctgcttgtatgaacaggttttgttagcctgacataattgagctccccagttaaaagtctccaatgacctgctggctgactgtggttgaacagaaggtctactctatggtacgggattctcatgggttaccttgatatcaccatggatgagatgccaccagacactgctgccagactgggttggtcccagtctttagataactgtcaagcttccttagtttatgataagtttaactattcttgggagaattaaagggaatgaagttccaccagtccactggcaaacactactcttctagctatagacaaggagacatcctgggattttatatgaatcttcctgaagaaacaaagacagtcaagtcattgcctgatacttacaaagataaggccttgataaagtttaagaattatttgtgttttgaggaaaaagactttgtgactgaagcagagaagagcctaaaagagacttcccacagtgagataagattttataaaaatggtgttagtcaaggcatggcttacaaagatattttcaaggggctttactttccagcaatcttaccagaaaacaactgcataatttccatgaacattggactgtgcttcaagtatcctccaaaggatctcacttactgccctatgagtgacatgggctgggatgctctggtagagcacactctggctggtgtcttggtgctagaaatggattcaatcactggacaagaaagtccttcaggggcaaacataaggacactgagggtcatcttattctacctgccttctctccttacttgtatcctaggccagcctatgctagcgcaactgtccacagatctctctctctctttctgtctctctctcgtgtgtgtgtatgtgtgtgtgtgtgtgcatgtgtgtatcaaatgatcaaacatcttcattcaaaagtccaagccctgcagcatcatgagacagtgctaccacacatgaagaaaatgttcaaagggcaccaaatagagatcgcatgatccaaagttatttctgatcccagaaaagaatggcacacaatcaatatgaatagtattagatatcaaaattatagtacaatctcatttgtttttaccatagattcaaactctctttagcatattggaaagcagaatccatgttctactgatgcaattccccttgaccatcatgaaagaattggactgaaagcaggacatttctgaagtctctggaggatacgtaacatgactgttggagggaatgcacataggaagaggtagtgaattatgtgtcaagtgccccaacaaaaggctgtcagtgtttgtctctgacacattgttggggagaaaggtggagtcacaggacacactgccatgggacccacgagacttgatcctacatcccacagcgggcagcctgcatcaacgtggtcatgcagggatagaaacacagccacagaaagctttcacctgcccaagcagcatctcccaagagccagcatgggtgctgtctctgctctgcttcttcctggactgtgtctcagagccctgagttctccctcacccagtttcccaatccccctcttctccactggttaccaggggttaggggagtggggaggggaaataaacgtttaaagggtacaaacttttcacttgggatgatgagaaagttatggaaattcataatggtgatgactgtatcacttttttttcagaggtggtaacttgctctgttgcccaggctggagtgcagtggtacaatgatagctcactgcatccttgaactcttgggtctaggcaagcctcctgcctcagactcctgagtagctgggactacaggtgcaagccaccatgccaggcaattctatcacattgtgaatatacttaacaccactgaattttacagttaaaagtgatttaaatggcaaattttatgttgtgtgtattctatgacaattaaaaatacacttgttcaaatgtcaaaatatatatgatgttatattcataaaattttccttttcacacttatatatttatcctattctaactcattctcatcaattaaaaaagtactgtaattactggtcattatgtactaaattttccataattcacattgaagccttaacccccaatattactgtatttggagacagagcattacagagggtaattaagatgaaatgagatcataaggaccggcatccttataagaggagattagaaaatggacaacataaaatgagatgaggacagagtgagaaggtggtcatctacaagtgtggacacatcttcagtttgtgtggagtaacagttgaagggctcgcccatcctataatgaaagttggaacaggtgccttgggcgggctccaggattaactgatctagtcactgcatcccactgtgggaccccagagggaaagaagcactgtggagattcctgagacattagaaatggagcctgagaaatttccaggacacccacatgggctccaggtgaagcaggggcccagaaggccttgtctgagccctgagtgtgacgcagcacctggccactagggggaggcaaactctgtgaatcctaagggacctgagctcttgctctgagccctgcccttgttaatcaccagccctgggagggagccgatttgcatggaatgtgatgtccctgcccacttcttcactgagggaataagaggctttagggcctcaggctcagctgagagactgaagaacccagcattgcagcagctccaccatggcctgggctcctctgctcctcaccctcctcagtctcctcacaggtcagggtgggcagtgggctgggcccccaaagggacccccacctcccagcctccatctccccatccctgctcttcctcctccaacagctcatcagccacccaccaacaggagccctcatgggtgtctgtgtttccagggtccctctcccagcctgtgctgactcagccaccttctgcatcagcctccctgggagcctcggtcacactcacctgcaccctgagcagcggctacagtaattataaagtggactggtaccagcagagaccagggaagggcccccggtttgtgatgcgagtgggcactggtgggattgtgggatccaagggggatggcatccctgatcgcttctcagtcttgggctcaggcctgaatcggtacctgaccatcaagaacatccaggaagaagatgagagtgactaccactgtggggcagaccatggcagtgggagcaacttcgtgtaacccacagtgacacaggcagaggggaagtgagacaaaaacctcccggctgatctgctctgtccacacttccttcccactggcctgactcacatttcagagggctgtctcttaactctgtatttaaagttttcaccttcccagacattttggagttctaattcacagcatatgttccctgtgtgtaaatattttctcaagagcttttgaaacattgaagtttgcacaccaacatttgtggtttttgccactcacctgtcccctgatgggattgaagtttccaggttgtggaactgctcacaggtgcgtttatcaggaaatcaccgtcaccagctcccacgacctttgtccatattcaacatttgtgagctgcctattcaatgatgggaactgacaatttccctggagacacaaggccttcaccctgactcacagtgtcacataatcgacgtggacttcagccatctccagtcacctccatgtgcacagagctctcatggtacatgtgcttggctgccctagaaagagagaatggacacacaccaaagatagtagaatgtgagcctgctctatatctgagattctgaaagaggcccccactgccttcacagaatgaattccttcacatgcagggagagagctctggtggaatcactctgcaatgctttctgatgacaaatacctggattgaggtcaaatttcacaggttaataacccttttcaagactacctccactacagactccagttcccaggcattaagcctgaggacccttgtagacaaccaacatggggctgtgaccagcaggagcaatgggtaactgtcccaggccctgccttggggctgctcacagccgggtgagccccactggccacaggctggcagaggctgagctgctccctgtgctcgctgatgaaactcagcagcctagtgctctcagggtccagcaaagcctcttgggcagggtcctgtgcctgttcccaacagccgctccttcgaggaccctcctaggcccacactcgagcagctccttcctcaacctcctctgtcctcacatccccttttgggttcctgaatcagtgatcaggtagggtctcatttagccagaagggagggagtagatttgcatgaacagcttcttcttttccctgagggcagaaggaaaaatagtcaagcctggggaagcccagcccaactgtgaggtccagaggctgtgtccaccatggcttgttgcctgaactcctctggtacccaatccttggtctatgtttatagactcaatgaaaatacctccctttctactggcctcttaatgctaacagaatcattttgtcccctaagcacaaatagcctttcgggttgctgggtgggatgacaactagagcagaagtctagcatgtgcaaccccattcctggcccatacatgtccctgctcttggcccagtctttgctggttactccctgaactctgaaacttcagggaagttgagtttctctttctcttgagattgtactcttgaggagctcctgaatttccaggtatagggtgacccctcctcattaaggacatggctctcagacttatccctggtttacttccccaggtttaggtctgtgagttctaaacagtttccctatgtttctttggttgatattttggttgatatttccctttgtttctttaggttgatattacattgggtaattacattggttgattacattgggtaaatatattcttgtagatatacacattataaactcttcccccattaagctcttaataaataaacttgtttgggtgccaatgtaccaatgtaggtaagaagtcttgacgcttttttttttttcttctgcaggagcagaggagaacctgaaaaaaaaaagagagagagacaagttcagcttataatactgttattttcatataaactctcctactttaaaaagtacaaaactagacctatactgaaaatatttttaaatatatcagagtatctgcatctgtcactgtggagatggttgcttgctctaccacagagcacaataatactgagcctcatcttcagcctaggcccctgtgatggtgagggcagtcttgtcttcaagcacagagtgtgagaatcaagtggggaccccatgcagagatggggacgtcagacacacacaccctggctcagcctcacctcatgctcctaacatctccatcttcttcacacagaggctgctgctgcttctggctaacacgggctcctgacgctggttctccagggcccaagagaaagtggtcacatatattcttctaagctgcaaaatttgtatttttaacccaacatgttattataacaatgtgttcataaagcacaatactaagatctatcatcaattgcacagttatgagttatttataggagtggcaaaataaaaagttacgcacacacacacgcagattcgggcaggccagaatttaattacaggagcaaagtttgatattagtgacacaacataacaatgatcctatgtataatgataaacatagcaatggaccatatgaagctttgaagaaacatagtggaaacacagaaaaaatctccctctcaccaaattttagaaaattctaaaaaaaattaaaaatttttaaaacccctcaaaactgagttaatttataaaatatgatacaaaacataaagtttacataactttaacactcttcatactcagtaaatgcaggttctttctccacaatttaatccagtgtaccaaaaccgagccttcctgtttgctggaggaaaacctcagcaccacaacagtagaaaagcaccaacctctctgcccacagtgcatcttccctccagagactccgcaggactctgcatggtctcctgagggccctgaagtggaggttctgtgatgagaagggggcatggatggcacagggcaagaatgtctgcagggtaagagtgttagaaggacaagcttcattcctctctgaaacaagcctatcttacatgatttatctttattcttctctacaaaaaaaaaaaagtcacaaagatagctgcaaagaaatatgtgaaattatacaaggctaagataacaaagaatattggaagaaaaagtaattatgacatcttctatcgaaacattttaggccaagcgtggtggctcatgcctgtaatcccagcatgttgagaggccaaagcaagagaatcacttgaggtcaagagttcaagacaagcctgagatcccatttttattttttaaaagcagcattaaaaaaaaaaggttcatcatagtctcctcttcccacagttaataatgagaatggagaaagttcaaaaagtgaaaatttaagcaactcttatgtacccataacaattttttaaattttgaaaaagaaatgaaacccgtagcacaactgaccaccagcacacaggtgcctcttcttcagctgcccctcctgaagtgacaaccaaacccaggggctcagcacaatgagctctccctctggccatacattccctgtgaggccccatctactctcatcccaacacaattgctccccaggcatctggggactgctgctgagattctccactcatggggtcctgggcacagcggtgttatcccagtccccctcttcctctgtgtcctgggagctggaatcagagtcagcctgatctggcccaaagcctacaattaagagccctgagtggcctctcctgctttccccccacattggactcttcctttcagtgtccttcctggggtactgtgtcactactcaataatatcttatgtcctcagtgctaggcgtttttcacataatatactcttgttagtttctcctcacctttccaagctcagttatcaactctaggctgatgatcctaactattcatttacagcacattgtcatataaaggccagcgatatctagaaaaaaaagtgccaataaatgtgtgtactgcatcttacgaatcactacaaggataccacaaacaatatccctgtatttaaatagagttcactcttcagacacaagagtttaagtggagttcaatataatagtttatatagataatagttaatataacagtttaaccagtctgtctgtggctaaaccagtcaccatctcctgcactggaagcagcaacaataagggtcttgggcttgtgtcctggtaccaacaatgaccaggaagtgccaccaaacctctgatacatatgtacggatccatatatttatatccatatcctgcggcgaatatccacctgcagggatccaggactgaatctcaggctaccggtctggcaaggaggcattgctgagcatctctgggctacaggcttaggacaaggctgatctctgctgttggctttaggcagctccatcgaggtccccacagtgctgcagtctggggaactgagacaaaggcacaccaggtttccaatgagtatgagctacctgcagcaccacccactgtcaggacaactgggctctttaccgtttgtgtgtatgtttcctggtgctgccactaaccagtgcccaggactcaagtcagggacagtgatctagagaatgcagctttgttctttcagagccagcccacagagggagcccttagcaatggcacattgtcagactgcttcaaaagaatcagaaagcctttgattccaggaacaggctgctctggggacagacccgagatgggtcaggggaggcagggacagattccaggtggctctctctcaggcacatgcactaatgcagaggtctaatcatccctattgtctactgaacaactactatgtgccaggctatggggagggctcaggatacagagttaccaagacagacaaggttcctgtcttcatagggctgacaccaaactaaagagagacagtcaagaagtcaatgggaataaggcatattgtggtgtatcaaagaggtgacactggccagaagggggagaatgatagaacgcctttagtgggtcgtaagcaaggaagacacagccttttgtttgagatttaggaggaaagtccagcttcttcaaggaagacaaaaaatgaggggatagtgcgaaggcaaaaggtccagttagaaagcagtggcattgtgcacatgagagatgaggtatctagcatctgatgtagcagctgagctgggaggaatgtgcatgacccacaccatggtgagaaggactagaggaaagaggtcactaggttgaggccctgaccttgtccttgtgatggaaacctgacaacagcctgcagctgcgatcaagcatgtcactctcctcttctctctggaaagctcataggactcaggactcattgctgcccttccctcttattcagtgagatttatttgaaccatcacttttcacacctggacagagacctgcttactttctcttgagcaaaagcactaagggtcgggacagagcactgtagagcacatgggatgatgccctacacactcaaggggctgctgttactgctgttaaagctcacgatcaaacctcccagagctctgtcagaaaccatgagacgggaggtgtcagtgctgaagtagctgatttgggggcacactgatttgcagtctgtgcagtcctgatttggaggtgtgggacagtgagggctgaagcccagcatcggcaagaggttcctgaggtgtctttatgtgccagggtccttgtgaccacctcagtgatgtgtgggggtaaaggtcaattgaaaagctggagagcagtggacaggcaggattctgtgtctgggtgagggacgggatgttcagctcctgcccaggcatccttatttacatttctgtttacctctcttcttccttgtctccttcccagggcagggttccagggctgttgtatctccgctgctctttctccatcacaaagagagcaagagagacaggttatgtgatgactaattccctcttcacactcagttgtctgattgtccttaggaattcttcctgaggatgggaatgtgctgttttatttctcccttacagtgagatcctagccatttgtgaggccaaggagattgaccccatcctgtcgatgaaggattatttataacacacatggtcaaaaagaacatcatcaacttctgcacaagtcagtccattcgtcagggttatagaagtgcacgtctctcagctgtcagcaatgggcttcaaatccccaggatgactaacttgtcaggatgggatcatccacattaagatgtttctttacagttagtgactctattcactgtgtttcccctgctgagatccaacctctatgagattgtttattggctgttttctgtcttgttattgctgaaaacacttcctggcactaaggacagactcaatacatgtttattaaatatgtgagttcacctacattggaatcccaggaagaggtacaaacctgaggtcaagataataatttttttaaaaattctgaatattttgtgtttgagattccaagttcattcaatggaagatactaagtaatgacttttgcctttggatttggttagcaggagaaggatatggatataaaaatgcaaatatatatatcacacatacctccccatggcccagagacctgaaagcccagctggtctctgcagctgccaattgcagcctctgttcactcatttatggtctgattgtcatggatccatatatactggatcccatgggttcatgtggagaaagtggagaggatgcgatgggctttcccagtcctgataaaagaaaccacaggaagcgaatagatcataaagcaaattctggggacagaaaaccctcgagagcaaataaactgctaatatgggtgagttgggaaaatgtctggcaatatttatataactaagaaactttacattagatatccttccttcacaatattcattacggagctttaaatcatccatatgatcaatgcaattcaaacattaaactcatcaaccccaagtcccatagcagactttgatgaggaaattcttgaaggaagaagggtgggtttgtgagctctgtgtccacagaagagatatttctccactaggagaactgggtaaagccaataaataattaggaatgtagatgcccaactggactatattctaatccaatatgcaatgctgtgagtcctgcatctgcaaattgttaacattcattgtgcttccttcagtttcccaattactacaataaattaactttagacatggatgattacagaacagatcaattaatgtgagagtccttggaatgtgttgctttaatccacaaaaattacggaacacttcaaatgtatatatttgttaatttatgtaccaattgtattttactgcttcgttgatctgttgtaaaaatcacccagtgagggagtaagctgatgggtaaaatgggttgaaaaattaaacaagatgaaccacattgatgatggtcaaatttggctgatgggtgcaaacaattcattagaaaagtatctgtatatttgtatggttcaaaagtttccatgctatccagtgtttaaaatatccttgtttgtaactgttctgcttttaaccggtgtacaatgtggacaaaatgtaagcttacactctgactttgagtagaagcccatcttctcccaacaggcagaggagaagctggtgtggagaacatggaaaacacaggagctcagggtttcccaggacagagaagcgagtgagcctggagccctaaaagcaagggtggggctgtgagttgggctgtgggtgtgtgcaggggccacagtgtgaagggcatgcttcagaggccacaggatttggattttataataagaatgatgagttactgaaggggtttaagccaggtagtaccttccctgcctcatctatatgagagggatctgtatccaaatgcctggaggagagcgtgcctgagaaaagtgagtgatcctgattctagattattcactaaagcacctcgtgagtctagaaacccaagggccatttgcacagttagcacaagagtagacgtggcaacattgagaagtgatggtctctgcctttgtctcctctggcattcaatacttgcaaaaacactttgcaggtaaaataaatactgatatttcaaataacctgaaagcatccagtaaaaaaataaaggtggcaatatcaagatacaaacaaattgtataacatttaggacaaatcgtttaccaaaaaatatgacacgactgtgaagaaagtgacgttttacttagggagataatggctaacctcttaaaacagagatatatgtcacactgtgacaggaaagtctacaaaatctcttaatgttcctacatcacaaaattgagtcaaatctctataaaacatatgaaaccattagatgtataacttttgctaaattgctgtctttaacatgtattggatcatttatttttcctggaaaattctcattcttcactgtccttttgaacaaccccagctgcccttcaacccagctcctcagctgacccatttttcatgatgcccaccctgatggcacatgtgggcaactcgatttttctagaatgccatgcaggggtgctgacaactttaaaagttatatagtacatggctgcacatcccacagaccaagactacttctgggagtgagaaatcacagtaataatgcatagcatgatagaagcagtgtctgggaatcagaccatggatatgtgaatacagacagtgactggagagctgcagagaccagctgggttctgaagtctctgagctttgggaaagtgtgtttcctgggaccagcgtcggatgttgtggggctgccctgtggttctgacacagctgctcagtaaggagcattcactccaagaaatccaggccttgaggctgggccctgtgctcactgatggagacttggcagctgtgtcccctctggcctggcagagttccctgagcagggacctgtgtatggtctcaacaggtgcttcctcccagggccttgcaaaaagaaaagcaaaccttcctcctgctcagtctgcagagagagcagagctgcatccccaggtctcaaggaggggcccggcaatccctgggtggaaacacatttgcatgagcagcccctcctctgcaagggtgggaagaaaaggaggcctggggcagcccagtcccactgtggggtaagcggctgtgtccaccatggcctggaatcctctcctcctcctgttcctctctcactgcacaggtaggaaaaggcctcagagaccagggtcagccacacagcctgattctgactcttgtgtcaaagatcactaaaaaaaatattaccttggtttctgtcttaaagcctatatatgcctgtgttccaggttccctctcgcagcctgtgctgactcagccaacttccctctcagcatctcctggagcatcagccagactcacctgcaccttgcgcagtggcatcaatcttggtagctacaggatattctggtaccagcagaagccagagagccctccccggtatctcctgagctactactcagactcaagtaagcatcagggctctggagtccccagccgcttctctggatccaaagatgcttcgagcaatgcagggattttagtcatctctgggctccagtctgaggatgaggctgactattactgtatgatttggcacagcagtgcttcttacagtgacacacacagatggggaagtgggacaaaaacttcaccctgatctgggtcttgttctgtaacagtttttaaattttaaaataaccagccaagggacaaactaaatttggaaataactttctagttgtaaaaggctcttctctcaatttcccatccattcttctgaagtctcagtaaaacaaaaccaaaccaaagcacctgatgaccctgaagtgttggctggttgtccatatgtgctaacaccactgcctgcggagctggacttttgttcttgaaagaagcaaaatgaggctttcctagctcacatcatagtcagagcctggggacatcctagcaggtgaacagtcccctacagcatggactctgctcttccagcgtacaagcagagacctccccttccatccccactagtctgttctcagggctgtctgaggctcactgtgtcccaggaacaaggcactcaaatatgaaatgctgcctgaggacacaggtcagggaattccagatatagtgctgacctggctcagtcctgggtacctgcatttcagtggaaatgtcaggagatgggattacgtctgagggtaactgtggacctgaggccggtaaacctctatgtaggacatgagagagtcaaggggaggctccaccatggctgaggcaaggctgaggctgctccttggccatgggggaagtaggtcccagggatgtgactttcctgcagctcattccactcaggaccacggggactgctgagggtgggtttgctgatccctcagggcctgtgttctcttctcctctattgcaccattggaggttctcactgagtcaggttctagtagtgagtctgtggaacatctgggtacagatactgtttgcttcaagtgactcctccccaggaaactcttgagaaggcccccatctcaatgtcacctttttctgcatggggagcagcagaaacattgggcattccctcccagaaagagcccctaattttgtgacttaggacatcagcgattgtccctcaggggtccaagcctgattctcctgctctgggtttattcccacagcctcctggacaacttctgcgctccagcctgaggactggctggttatcagtgtcacacagctgcatcctgactccatgttaccaagggttcctattccatggggaaatgagagaaagatctgccccactcatcctctctgccccatccctcctttatccttgcctgtgaccaacaccagttcatgccaagacttttactgtcacttgtgttactgaaagcagagcaagggtgcagggatgataactccttttcttactggtctccccaatggaaacagaatcaacttgtttctagaagcaaaaggagctgcccacacatggtgggtgtggatgaggtggggatgacaagaaagaatccagccagtgtgacccagaagtccaggagccttcagcctggtcccacaggtgtcctctccttttggtgcaggtgtgctgatcatttcctgagctctgaatctgtgggaaagatgacaagaaaggagaatccagcctgtgtgacccaagacccatatgtgagagcggaagtctgacacttaagaaaacgtgggctcagcattctgagaggtctggatctggctcggcctagagctgctctagaagagaagcaagagaaatgctcagccttaggtggcccaggcacagtggtcctgtcaaaggtctgagctctctgcaacatggatatcctgcagagacatccttgggaggctgtgatcctagaatgatgtaaaaatgctaatggaagtgagcaggggatggtttatggaggaatgaggagatgggtgtggggtcagatgtggtaaggagggtgcaccctgaagaggagactgtccattgtgactcataggagaaggatgcccggggcctagggcagtgacaaaaagaggacctggaaggaccggcaccctgaagacacgtagagactggggtttggtttgtctgtgagggttcctgaggagaatcacataaaaaatccacagtcagtgtcttctgtccagggctcactgtcgcaactgttgccccttccttccagatcctctgggtgtccaggttccttagccgtggatctgctcctctctctgccctcagcctaagagctgatggggcatccaccaggaagcgcatccgtgggcagggaggaggccgtgggcagccttctcctgtatgtgagacactgctcagcctcggtgaccccctgttcattaaggtgggaggaaaggaaaacaaaattcactgtgaacatctatgcatcatcaaagaaaaagcaatgagaagaaacaggaagtgaagcccagctctaatagtttatttctacttggaaataaataaaacaatatgcctgatgtgttatataaacacaataaactttttataaaaactatgaaaattatgtaaaggagcatggcttacactaaaaggaacatttaaaataatgacacccttgaaatgcaatcccaaaacacagcatccattttatttcagttacatatacggactggttttatttaaatgcctgcaataaatctcactattttgttgtttaaatggagcatttaaaatctcattgtggccaggcgcggtggctcacgcctgtaatcccagcactttgggagtctgaggtgggctgatcacaaggtcaggagttggagaccagcctggccaacatggtgaaacccagtctctactaaaaaaatacaaaaattagccgggcatggtggcgcgtgctggtaattccagctacttggaaggctgaggcaggagaattgcttgaacctgggagatggaggttgcatttagctgagatggtgccactgcactccagcctgggcaacagaccaagactccggctcaaaataaataaataaataaacaaacaaataaataaaaaatctcattgtattgcaactgtctgatgatacattcacaagtataaatatcaacataaccatccagctgtttccctccatccacgtaaaattccccaaacaaatatttgttaagagtccagggtgtatcatgccagaactcatgcaatcataaacacaatctatttcatttttcattttgattaacagaattatcttttttcttaagattattgtttttagtttattagattctagatgtcattacagaccaaagatgaataattttcatcatcttcaagccacccccacaagactcactactgaatttgaaccataatttttccctggaaatcctagttggggtgctcgatgctaagagctatcacatatcaggctcacctgaggacagactctggtcgtcaaaccaagttaaaattttaattcttcccatgttcaaagactgaacatctttgctctttttgctcataagtgaaacactccaaagacatttgccaggatcccccacagactggcattcagtgcttggaggacagactcctaggcaagatccttggtcacagtatccggatgactatgactgcaaatctggggaagtagagggagaacaaagatttaccaggaaaaccctctgggaattcctccccagggcatcccagaggtaagagctccctttctcctcagcgcagcaggatccacagaggaagtggagccctggccaccagggaggagtcacatgagaggagaggacccggtgtccaacactggtggggaagtgagtccatggggccggtccccgctctgggcttgatcctgaaataaaaggactttgtgtagacatcacctgagtcctctacaatgtacagccaaagagccatagacagattcactcctgaggagtccagtagagcgtgaagactgccctgaggtcacaggagggagacacaggtgccaccttactgggccgggacttgggagcgggggcagtggccagaaaacagggcggggcggaggcagcggtgaatctcagaggctctggtcacctgatcacagaacggtttgccttagtctggacactagggggcgcttggggaccatttctgagaagacttggggtaatcagagcagaaccaggcacctgccctgcctgatgtcctctgctcagggctggcagctgtgtcctgtgtcctccccaccccctgggaccacaaagctccacccctgccacaccctgacatactcaagcccaggagcctgacccagggctcagggtggggtcaaaaaccggggggatctgatttgcatggatggactctccccctctcagagtatgaagagagggagagatctgggggaagctcagcttcagctgtggtagagaagacaggattcaggacaatctccagcatggccggcttccctctcctcctcaccctcctcactcactgtgcaggtgacaggatggggaccaagagaggggccctgggaagcccatggggccctgctttctcctcttgtctcctttcgtctcttgtcaatcaccatgtctgtgtctctctcacttccagggtcctgggcccagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctatagtaataatcagcggccctcaggggtccctgaccgattctctggctccaagtctggcacctcagcctccctggccatcagtgggctccggtccgaggatgaggctgattattactgtgcagcatgggatgacagcctgagtggtcccacagtgctccaggcccagggggaactgagacaagaacccccttcctcctctgtcaggagggtgagccccggcagctgctgctcaggcccggcctgtggcttctgctgctgtagcttcccccatgggtccaagggcatccagggccctgcctgagagtggaggctcctcctccccttcatcctcagagtcatgaacaggctgtccaggaaacagaacatcctgcttcctgcaacttgggacacagggtctctgcactgaagtcctggactgaggtggcaggtacagctgtgtcgtcacagacccacctctgatgggaaacctgtgtctctgtcatcctccttttcccatttccaggagtttccagagtggtgtcttcctccccctgctcctcagtgtgaatccctgtgcttcctttctctccagccaattctttttttaataaaactcctttcatgtaggaataatgcatatttaataaaccacccagatttataataggaaattagacaaatgttgacattttttgatccttgaatacatcaccaccaacacgcagctatgcaacctgtgaccaaccccagcaacccctcatgaccccttgtcatctccctccctcccttccccagtgctatcctgtgcagccacagatctgtctctgtcactattgtttgctttccattttttggaatgtatcagtgttatcagacattatcttcccatttgttctggcttttttcacactgcaaactccttttgggattcttcctgttctcgctgaattgcacccatcccatagagggctcattactacctttgagggcctttaggttgattattcctgattttgtttatttattttaaagtttgaatttatcgtccatcaaaatcaaactcttggagttatgttcatctaaggtgacaggagagtctgtgatgtcttgtcgggattcttgcttcttcatctcttgcctctcgttctgtctatattggaagaggttctcatattctatttatttacttatttatttatttgggtttttaaggatttcagtgtttttttctctttaattattaatttttttattttaataggtttttagggaatcggtggtatttggttacataaataagttctttagttgtgatttctaagatattggtgcactcatcacccaagtagcgtacagtgtacccagtgagtagtcttttatccctcaccccgcttctaccatttcctcccagtcctcaaagtccattgtatcattgttatgcctttgtgttctcatagcttatctcccacttatgggtgagaatatgccatgctttgttttcaattcctgagttactgcacttagaataacagtccccaattctatccaggttgctgggaatgccattattttgttcctttttatggctgcatagtattccatggtatgcatatatttaacatttcctttatccatttgttggtttatgggcatttgggctggttccatgttcttgcaattgcaaattgtgctgctataaacatgcgtgtgcaactatcttttttgaataatgatttctttttctctgggtacatgcctagtcccagattttgggactttgctggatcaaagggtacatctatttttagttccttaaggaatctgttttccatagtggttgtactagtttaccttcccaccaccagtgtaaaagtgttttgttttcaccacatccatgccaacatctattattggccattcttgcggtattaaggtggtattgtattgtagttttgattggtatttccctgatcattagtgatgctgttcatttttctttatgtctgttggccattcatatatcttcttttgagaatttttatttatgcctttagcctactttttgatgagattgtttagtttttttcttgataatttgtttgaattctttgtagatgctagcccttagtcattaggtggatatgtagattgtgaagattttcttccactcggtgggctgtctgttaactctgctgattatttcttttgctgtgaagaagctttttagtttaattaggtcccatctatttatctttgttcttgttgcatttgcttttgggttcttggtcatgaagtctttgcctaaaccaatgtctagaagggtttttctgatgttatcttctagaatttttattgtttcaggccttaggtttaagtctttgattcatcttgagttgatttttgtataagctgagagatgaggatccaggtttatttctttcacatttggcttgccaattatcccagcaccatttcttgaacagggtgtcctagagtatagtttgaagttaggtaacctgatgcctctggatatgctttttgttgttgttgttgtttgtttgttttttcttagtcttgctttggctatgcaggctcttttttggttccatatgaattttaggattgttttttctagttctgtgataaatgatgttggtattttgatgggaattgcattgaatttgtagattgcttttggtagtatgatcattttcacaatattgattctacccattcatgagcatgggatgtgtttttatttgtttgtgtcatctatgatttctttcagcagtgttttgtagttttctttgtagagttctttaatctccttggttaggtatattcctaagtatttttttttttgcagctatttgttaaaggggttgagttcttgatttgatattcagcttggtccctgttgttgtatttgtgtgccttaattttgtatcccgaaactttgctgaattcattcaccagttctcggagctttttgaatgagtctttaaagttttctaggtatacgatcttattataagcaaacaatgacagtttgacttcctctttaccaatttggatgcccttaatttctttctcttgtctgattgctctggctaagacttccagaactatgttgaacagaagtggtgaaagtgggcattcttgtcttgttccggttctcggaagaaatgcttttaagttttttctgttcagtataatgttggctgtgggtttgtaatagagggctttcattaccataaggtatgtctcttctatgccagttttgcagagggttttaatcatgaagtgatgatggattttatcaagtactttttctgcatcgattgagataatctgtgatttttgttcttaattctgtttatgtggtatattacatttattgactttgtatgttaaaccatccctgcatccttggtaagaaacccacttcatcatggtggactatgatttgatagctgttggattgggttagcaagtatttagtttaggatttttgcatctatgttcatcagggatattggtctgtagttttcttgttttgttatgtccttcccctcattttggttttagggtgacactggcttcatagaataatttattccctctttctccatcctgtgggttaatgtattagtattctccagagggaaagaactaatggaatatatatatatatatatatatatatatatatatatatatatatgagtttattaagtattaactcacataatcacaagtcacacaataggccatctgcagggtgaggagcaaggagagccagtccatgttccaaaactgaagagcttggagtccaatgttcaagggcaggaaggatccagcactggagaatgatgtagggtgggagactaagccaatctctctttcacatttttctgtctgcttatattctagccatgctggcatctgattagattgtgcacgcccaggttaagggcgggtctgcctatcccagcccacttactcaaatgttagtctctttggcaaaaccctcacagacacactgaggatcaatactttgtatccttcaatccaataaagttgacactcaatattaaccatcgcaattactgtcatagacttggtgccaattcttctttcaatgtctgatagaattcaaatgtgaatctgtctggtcctggacttttttcgggggttgactttttaaaattattatttcaatctcactgcttgttattggtctgttcagagtttctacatcttcctggtttaatctaggagggttgtatatattcagatatttatcaatcttctctaggtttttcagattatgtgcatattatcttttatatagtttttttgttttaattttatttagttctggtctaatctttgttatttcttttcttctgctgagtttgggtttgcattgttcttgatcctccagtttcatgaggtgtgaccttagaaggtctgtttgtgctctttcaggctttttgatgtatgtatttaatgctaaacttttcccttagcactgcctttgctgtatcctggaggttttgataggttgtatcaagatttagaactactgcaaccttactattgaccaacaggtttttaattcctaagagtgtgacctcactgaatcctgacaacagctttatgattgcttttcatgcagtaggccctggttagagaggggagtgcttgtggcctggaggtaggattctgcaatttatcaaataaaaacactggaggtcagttaaatttgaattcagtaaaacaatgacaaagaattagtatgtgttagtatctcccacacaatatttttcagttgaaatacaacttatctgggtgccctgtcgtttatctgccaactcctcacaggattcaaggcttggaagagggagtgttggggctggcctcgtcttactgatgccagttctatgagatgaacctcaaaggcagagcttctctaacacagctaccctcaagaaagcacgtcagttagcactaaatacatggtataagttcctcaatcaatagtgcctactcacttccctaattcttctttgtattattcttcaagtctgcagactcaggacctctgctggggttgctgcagccagagttctggatgagggacctcataagcctttcaaaaccagacgcagggggactactcagtccccacgcagcggggcttaagccaggggtaaataagtaagaaatggaagagctcagcatggctctccctttgtccagtgagacagcaaactccagggtccttttgatgctgaaggtgcgtgggctgagagtagggggagacccaccctgagagcccagaacttccaggacaggacttgtcagtctgaaaaggggccacactcttgagtggggaagaaggaggcatctctcgccacaggcctgcatttctggtggcttccccttcaccaaactgtgctctctgctctgatgtctatcagagaatctccttcagtgagactaagatcccaggactttactaaaaataacagcatgaaccagatagatttgtaatggtaccagaattctctgcagagcaatgagtacaaatgcagcttaacaaaggccctcacactcataactgaaaggctcagtaggtctgggtctggggcagtactgggtgctgtaggcttgtccttgaggcatctacaagtaagaacaactgggaagccatcctgctgtgaccctgtatcatctgctcactgctcactgggctcagcagctgtgtcctcacagggaaccaggttcagccaacctggccttctccaccccacctagaacatgtattccggtgactgtctggactgaggttctatgaagggactggcagacaagaagagggggctgatttgcatgaagaaaccattgcacaccctttcctttcatctaaaacccattaatggatactctggggccacccacagaagtctagcttgtctcctaaatttgagagttaggaaggagtcatttcttatcaatctacaggtagaggggccatcagcagcagagggccagagtgagggagaaactggcttcgagagactcatcaacacagccaccaactcttggacaaatggggcacttgctataacagtcaccccaagctactcacaggagcctgagcctagtcccctcaccttattgcttttgattctggtccatgcctctgttttccctggactctttgcccatgtctgagtccagggaggcaggggttgctccatctcagtcaaaatctatgtatatgtaacagctactatggcttggagcagagtccactgttgtacctatgagggcctatcctgctccaccatccccttacacaggtgacaactgctatgtttctgatggactgacccttttcccctggaagacacaaggtatttattcctttctaacacaaggcatatagtggagggggtaggggtgggtgtgaagcagagtggcttttccagatataatgcagtaaggccctggttacagaagatcatttcacaaaattccacaccctttcatgataaaaacactcaacaaactatgaatagaaggaaacttcctcaacatagtaaaggccatctatgaaaatcctacaactaacatcgcatgcaatctgaaagaccaaagatatgtttttgtaatatctatcaggatcaaagcaacaatgcacattttcaccacttctattaagacagtattggaagacctagccagagtaattaggcaagagaaagaaataaacagaataaaaattagaaataaaaagtaaaattatctctgttttcatttgatttaatgtcatatgtagaatacccttaaaagtcccacaaaagaaaactttgtcagaatgattaaatgtattcggtaatatttctgaatacaaaaatcaccatgtaaaattatctcatggctgggcatggtgactcatgcatataatcctaacactttgagaggctgaggtgggaggactgcttgtggtcaagagttcaagaacagcctgggcaacaaagcaaggccctgtctctacaaaaagagagagagagagatgaaagaagaaaggaaagaaagaaagacagaaagaaaggaggaaggaaaagaaagaaagaaagaaagaaagaaaagaaagaaggaaggaaggaagaaagaaagaaagaaagaaagaaagaaagaaagaaagaaagaaagaaagaaagaaagaaagaaaatctcttacatttcaatacttgagcaaataggaaacaacccaaaacaaaatcgggacccacacccattaggatggctttacccaaataatggaaaataataagttgtagcaaagatgtatagaaattataactgtaatgcattgctggagggactataaaatgatgcatccactgaggtggccttgatgacagttgctcagaaaactaaacatagaattaccattttatcagaattttcacttctgggcatgtgcctcaaagaattgaaagcaggatctcaaaattgtccacccttgttcgtagcagcatcattcacaatagctaaaaggtggaggcagcccaagtgtcatctaatggataaacggaatatagtatacacacacaagggaatagtattcaaccttaaaaagaaagttctgacccatgcgatggcatggatgaaccctaaagacatcatgccaacagaaataagctggtttcaaaaggacaaatgttgtctgtttgctcttatatgaggtacctagagtagtgaaatccatagagacaagaagtagaatgatgttttccaggcatgaaattttggtttgggaggatgaaaaattcctggagacgaatggtggtacgtgactgtacaacaatattactttacttaatgacactgaagcgtgtggttgaaaatggttaaaatatgtgttttgtgtttgaataatttaccactgtcaaaaacaaaaagatttatatttggtgcagttacaagaaccataaaaatatacaggactaggagagtgtgcctgagtagccaggacacccttccttctgtgccagccccacagcatcctaacagaccaatagagttggaggtacctcattacaggtgacacaaaataacatgagaaagtctgagaatggccatgatggtaggggtgggtgcctgacccagtccaggagcagcctctagtgcaactatggccaaagaaggggagatgaagctggtggcaatggtagcagcctctccagctggagagggacatctgctgtcctatgaaaatggctcatagttgatatatctggcaaagacatgtcatcctgtctacctttcatgaccaactacagttttcatagtgctttggttaagctggcatggcagtcccaaacacaggatgaatgctatagcatttattgataaatactgggagtgcatgatgaccattcagacacctgggaaaatgactaggctggataacatcgttaaaacaatgagtaaagagagagatttattcttggtaaaggacctcctggatccagggagtaaagacctgaaagaagattgcccaagatttggacttttggatcaggactttggtaaaactgatcctgtttatgacaagcaaaagcaaagcagtgccctgtctgtgagtgggaatctgaatggggcaactgaacaggaagcagcagaaaagaggaagaggagttcagtgcaaacagcaagatgagatctcagagaccaccaagaaggcccagagtgaccctttgttttctgctcagcgccttgccccttacaccttttaaaacacccatttaacaaggatggctactggtatattccaaccgagcctgagccacacacccttggtcctcagaaggttgaagactgctaggcaggagaaattattcctgaagacctctacggagcctgtttctgtgaacaggttttgttagtctaacatgattaagctctccaggtaaagatctccaatgaccagctggctgactgtggttggaaagaagggttactctatgatgcaggcctctcatggggtatggaaagggacctgggactttgaaatcatcaaggatgagttgtcaccagacaccactgccaatggggttggtctcagtcctaaggtaaccatcaatctcccttaggttatgataaacttagctattcttggcagagcaaaagggaaccaagttccacctgtccactggcaaataatactcttctagctacggatgaggacaggtcttgggattttatattaatcttcctgaaaacacagagacagccaagttattgcctgatacttacaaagataaggctttgataaaatacaagaattatttgtattttgaggaaaaagacattttggataaagcacagaagagcctaaaacagattctgcacaggcaaataatattttataaaaatggtgtcaattaatatgttgaataaaaggtatttttgagggggttgatttccagccatctcacaggaaaacaactgcatggtttgcattaactttggactgtgctgcgagtgtcctccaaaggatctcgcttactcccttatgagtgacatgggctgggatgctgtggtagagcacactctggctgatgtcttgtatctcctggagacagaagtggatggaggcacagtcctccatgggaaccctgaacaggtccctctttcttttcaaatatggactttctggggaatgatactggacggcttctgtagttgttgttgttttttgaactgtctcaaatgttttcccaaagatgctacagaacatagcctatccatttagcaagtgaaaaggctgaataagactgggagagactccctgctcatcatcattcttcttccacttccagtgactgctcatattctgtgccataagccaacagctactgatcccaagatcttgtaatccctctgtaaaactggtgctgtactgcataccttgccagctgggactttttatcttactgcattttccaggaataaataaccttgtcccaaaaacaaacatatttaaagacatttccttctgtggacactgattccatgctatctgttttccaaggaagtggtgagcccgtttctgagaacacctggtatcaatggctgtcccttccaaaccaagcaaaaagtgatttcttgtcggtgtggatttggttttgttattaattttaaaacatacctttgaagacttagatctctgaaactactagatctctagaagtgtaattgtgaaaaaagtttgcttgcatcatcaacaacatgaaaaactctttctaaataaaatttgttttgaagttaaaaaaaagaataatgcaagattggaaactgggaggtctgaagattcccaagagcactctcaattctgaagctaattttcagctcagggaccccaaacagcccttcacttcttatgagtccctagaaggactcacatgactcactgaaaactgtgacattcattaatgtgatttttctacagtgaaataatacagattaaaataattcaaggaaagagacacatgggcagagttcaggagaattccaagcacaagcatccatttgtcctctcccagtggagtaatagacaacgctgcattctgccggcaacaatgtgtgattctatgtaggaagcattgccaaccagcaaagctcacccaggcttggtgtccagaaaaattttgattggtggggtgggtgagagtggggttgttatgtagaccttgatgaccatcctcatggctcacttgagtttccactgaattgacaataaaacttcaatcttcaacctttggtcattttcttttaaaaaattttctaaagaaaattattttaaaaagtctcatataaacgagctgtttatccaatatgaggctcaacgcaaatagtttcaaaaagtcagtaggtcattaaaacaattatttagtcattcaaactaaatatttagtcattcaaacgttgttatctggtgttcagatagcaacgaacaccatgtagcactaaaatcgcattatagtcacaggggcaggatttcagcaacagcaagagaaagtaatacaaacaggaatgagcaaagaatagacaagtaatgggtatgaattggcctgggaaatattgtggcaatgtccaaagacaaatcaatagttatttgttaaagaagtgaaagacaacacattctcagtccaggaaagccaccagggggtggtctgggtctcttggattgtaagaagctcaagaggttcaaacttaatgaaccctgcacagatgctcactgactcatggaaatgttagagcagctgcttcctcccacaggacaaatccacagcacacagccaccctgggctggccccccacagtgtagctgctctcagggctgtggacccaggtggtgataaaggcagtaaagatttgcataaagcagcacacagcacaccccctccgtgcggagagctcaataggagataaagagccatcagaatccagccccagctctggcaccaggggtcccttccaatatcagcaccatggcctggactcctctctttctgttcctcctcacttgctgcccaggttaagagagatttcaaataccagcctttggagggatccctttttctccctttctaattcctaatatatgtctgttttttttgtttcagggtccaattcccaggctgtggtgactcaggagccctcactgactgtgtccccaggagggacagtcactctcacctgtggctccagcactggagctgtcaccagtggtcattatccctactggttccagcagaagcctggccaagcccccaggacactgatttatgatacaagcaacaaacactcctggacacctgcccggttctcaggctccctccttgggggcaaagctgccctgacccttttgggtgcgcagcctgaggatgaggctgagtattactgcttgctctcctatagtggtgctcggcacagtgacagacccatgagaggaaccaagacataaacctccctcggcccttgtgatgtggagatcacatgatcagacatgccagatcccaagatagcctacatgtggaccagccatagaaaggggaaggaaagggtttgaattgattcctatttctacttaagtcttgatgtgtaggaaatgtaagaatgatttgggagtaactggatcaaaaaaaaaaaaggaaaagttaattgttttctattctaaaaggaacactaacagcaggatcacatataaaggctgggtcaaaatgcatttcctccagaaagaagcatcttcagtgtataggctttctgagctaagagcaaagaaactttttttgcatattactgaagtttgttttattgagttactttcaaaccaatacctccagaaagaagcatcttcagtgtataggctttctgagctaagagcaaagagaagaaactctttttttgtatatgactaaaatttgctttattgatttactttcaaaccaatacatgcctattatataaaataaaaatattaaaaaccaccaagttcactgcaaagctgtctcatcagaaacaatccaatttcttcatttggatgcattctttcatttttgttctcaatatttccacaatgggggtcataccttgtgctttttctctctggttttacacatctttatgcctcctcccacaccctgtgcctctctcctgactctcagggtcctgggcagtcagggctcacttggtagcctgcacagtctgtctgtgacaaaaccagtcaccatctcctgcactggaatcagcagcaataaggttcttggaattgtgtcctggtaccaacaatgacaaggaagtgcctccaaacttctgatgtatagaagcaaatatctgcctgcagggacccaggatggatgctcgggctaccagtttggcaaggaggccttcccaagcatctctgggctccaggctgaggacaacgctgatctcaactgttggcttcagacagccccctggaggcccaaacagtgctgcagtctgggggagtgagacaggaacatgtcaggtctcctaggagcacgacctaactacagcaccatacaaccaggacagcagggctgtttaccatttgtgtgcatgtttgctggtgcttctgctaaccaggacccagggctcagattagggacagtgatctagagaatgctgctttgttttctcagggccagacttcagagagagcccttggccacagcattgtcagactgcctcagaagaatcagaaagtccttgatttctggaacaggctgccctgggaatacagccatgataggccagggcaagcagggacagaatccagctgggtctgtctcaggcatgtgcactaataaagatctctgtttgtccttattgtttactgaatacctactatgtgccaggctcaggtctcatgctaaggatacagaggtgagaagacagacagggattctgtcttcacaggactgacaccatgcagaaaagtgagggccaacaagtcaataggagtaaggcatattgtggtgtatccaagaggtgacactggccagaagggggagagcaataggaagcccttagggagttgtaagcaaggaagacacggagtctgatgggagacttaggagaaaagtccagcttctccaaagaagatgaaaaaggaggggagagagtgaaagtggagggtctaattaggagacggtagctttctccacatgagagatgaggtctccagcaagtgatgaagcagctgaggtggtgaaatatgcgtgacccacaccatggtgagtaagaccaaaggaaagaggtcactaggttgaggcccaaagcttgttcctgtgatataaacctgacaacatcctcttgccgttactgagtgtctcacacaccttttttctttggatatctcctgggactcaggactcattgctgcccttccctcgtattcagtgagattcatttcgaacatcacttttcacacccagagagagacctggctcctttgtatggagcaaaagcactgagggtcaggacagaacattctacagaacatgggatgatgccttacacactaaaggactgctgttaaagctcgtgatcaaacctccctggagctacatcagaaaccacgagaggggaggtgtcagcgcttaggtgcctgatttcagggcacactaatttgcagtttgtccagctccctcccaggcatttttatccacccctctctttacctcctttcatccttgcctccttctcagggcgggcctccaggcctgtggtgtctctgctgctctgtctccatcacaaacagagcagtagggagattatctgataatgaagttccctcctcatactcagttatctggttccccttaggaattcttctgcatcatgggaatgttctgttttatttctgccctacagtaggaacccagccatttgtgaggccaaggagattgacctctttccgttgaagcaggattatatttaacacatgtattcaaataacatcatcaacttatgaacaagtcaatccattcttcagaattatagaaatgcatgtctctcagctgtcagcaattggcctcagatccctagattggcgaacttgtcagggtggggtcagccacatgaagatgtttctttatagttagtgactctattcactgggtttcccctgttgagatccaacctccatgagactgtttatttttgttgttgttttctgtcttgtcattgcccaaaatgctgcctggcactaaggaaagacttaatacatgtttattaaatatgtgagttcacctacattggaatcccaaaaagaggtacagatctgaggtcaagttaataatttttaaaaaaattctggatattttgtgtttgagattccaagttcattcaatagaagatattaagtatgaagttttgcctttggatttggttagcaggagaaggatatggatatgaaaatacaaatggatcacacatacctccccatggcccagagtcttgagtgcctagctgctctctgcagctcctaatcacagcctctgttcactcatttatggtctgattcccatggatccatacatgctggatcccatgggcttatgtggagaaagtggagagaaggtgatggccctgctaaaaaaaccacaggaagcaagttgataatgaagcaaattctgggcacaaaatctctcaagagcaaataaactgcagaatatgggtgagttgggaaaatttctggcaatatttatataactaagaaggtttacattacatatacttcaacaaaatattaattctaaagcttccaataagtcatatgatcaatgcaattcaaacattaaactcatcagtcccaagtcccataatagactttgatggagaaattcttgaaggaagaatgatgggtttgtgagctctgtgtccacagaagagatatttctgcactaggaggactgggtaaagccattaaataattatgaatgtagtgcccatctggacttttttctaatccaatatgcaatgctgtgggctctgcctttgcaaatcgtagcattcattgtacttcctccagtctcccaattattacaataaattaattttaaacatgaatgattaaaagacaaatctattaatgttagagtccttggaatctgttgctttaatgcacaagaattatggaacacttcaaatgtatatatttgttaatttatgtaccaatgataaaatactgcttccttgatctgttctaaaaatcacctagaaagggagtaagttgatgggtaaaatgggttgaaaaattaaacaagatgaaccatattgatgatggtcaaagttggctgattggtgcaaacaattcatcagaaaattctctgtatatttgtatgactcaaacgtttccatgctaaccagtgaaaatatccttttttgcaatgagatgtttatgttctgcttttaccaggtgtacaatgtggacaaaatgtaagcttacactttgacttcaagtggaagcccatcttctcccaacaggcagaggagaagctggtgtggagaacatggaaaacacaggagctcagggtttcccaggacagagaagtgagtgagcctggagccctaaaagcaagggcaggggctgtgagttgggctgtgggggtgttctggggccacaatgtgaagggcatgttgctgaggtctcagggttcaggtttcataataacaacgaggagttactcaaggggcttaaaccagggagtgccctgcctgccctatctgagtgacagggatctctctgaatgccttgagaagagagtgtctgagaaaagtgagtgatcctgattctagattattcgctaaagcacctcgtgagtctagaaactcaggggccatttgcacagttagcacaagagtagatgtggctaaattgagaagtgatggtctctgcttttgtctcctgagacatccaactcatttgcaagagaattttgcaggtaaaatacatactgatctttctaataaactgaaaacacctagtaaaaaaatacacgtggtaatagcacaatgcaatttgtataacagctagaacaaattcttgaccaaaaaatatgatgcaactgtgcagaaaatgacgttttacttagggagataatggctaatttcataaaatagtgaaatatgtcacactgttcactggtaaaggtaagtctagcaaatctattagttttcctgtatcacaaaatcgaatcaaatctctttaaaacgtatgaaaccattgtaaatataacttgtgttgcattgctgtctttttttttttttttttttttttttagacagaatctcgctttgtcgcccaggctggggtgcagtggcccaatatcagctcactgcaagctccacctcccgggttcccgggttcacgccattctcctgcatcagcctcccgagtagctgggactacaggcgcctgccaccacgcccagctaatatgttgtatttttagtagagacggggtttcaccgcgttagccaggatggtcttgatctactgacctcgtgatccgcccgccttggcttcccaaaggaattgctgcctttaacatgtcattgatcctttatttttcctggaaatttttcattattcaccatctttttgaacaaccccagctgcccttcaacccagctcctcagctgaccccttttccatgatgcccactctgatgacatatgtgggcaaatagatttttctaaaatgccctgttggggtgctgacacctataaaagttatgtatgtacaggtctgcacatcccacagaccaagactacttctgggagtgagaaatcgtagtaataatgcatagcatgatagaagcagtgtctgggaatcagaccatggatatgtgaatacagacagtgactaaagagctgcagagaccagctgggttctgaagtctctgagctttgggaaagtgtgtttcctgggaccagcgtcagatgttgtggggctgccctgtggttccgacacagctgctcagtaatgagcattcactcagagaaatccaggccttgaggctgggccctgtgctcactgatggacactcggcagctgtgtcccctctggcctggcagagttccctgagcagggacctgtgtatggtctcaacaggtgcttcctcccagggccttgcaaaaagaaaagcaagccttcctcctgctcagtctgcagagagagctgagctgcatccccaggtctcaaggaggggcccggcagtccctgggcggaaacacatttgcatgagcaacccctcctctgcaacagtgggaagaaaaggaggcctggggcagcccagtcccactgcgggggtaagaggttgtgtccaccatggcctggactcctctcctcctcctgttcctctctcactgcacaggtaggaatagacttcagagaccagggtcagccacccagcctgattctgactcttctggcaaagatccctgaaaaactttaccctggtttctgccttagcacccattaatgtctgtgtttccaggttccctctcgcaggctgtgctgactcagccgtcttccctctctgcatctcctggagcatcagccagtctcacctgcaccttgcgcagtggcatcaatgttggtacctacaggatatactggtaccagcagaagccagggagtcctccccagtatctcctgaggtacaaatcagactcagataagcagcagggctctggagtccccagccgcttctctggatccaaagatgcttcggccaatgcagggattttactcatctctgggctccagtctgaggatgaggctgactattactgtatgatttggcacagcagcgcttctcacagtgacacacacagatggggaagtgggacaaaaacctcaccctgctctgggtcttgctctgtaccaatttttaaattttaaaataactggcctaggcacaaactatatttggaagtactttctagttgtaaaaggctcttctctcaattttctatccatttttctgaagtctcagtaaaacaaaacaaaacaaaacaaaaccacctgatgaccctgaagtgttggctggttgtccacatgtgctaacaccagtgcctgtggagctggacgtttttttcttgaaagaagcaaaatgaggctttcctagctcacatcatggtcagagcctggggacaacatagcaggtgaacagtgccctgcagcatggactctgctcttccagcgtacgggcagagacctccccttccatccccagtagtctgttctcagggctgtctgaggctcactgtgtcccaggaacaaggcactcaaatatgaaatgctgcctgaggactcaggtcagggaattctggatatagtgctgacctggctcagtcctgggtacctgcatttcagtggcaatgtcaggagatggcgttagatattagggtaactgcgggcccgatgccagtaaacctctatgtaggacatgacagaatcaaggggaggctccaccatggctgagacaagccagaggctgctccttggccatgggggaagtagatcccatggatgtgactcctgtagctcatcccactcaggaccacggggactgctgagggtgggtttcctgatccctcagggcctgactgtgttctcttctcctctcttacaccattggagcttctcactgactcaggtctagtggtgagtctgtggaatatctggatacagaaactgcccaatatttgcttcaagtgactcctccctgggaaactcttgaggaggcccccacctcaaggtcatctttttctccatggggagcagcagaaacattggccattcccatggaaatggctatgaggcctcccagagagaacccctaagtttatgacctaggacaatagtgatggtccctcaggggtcccagcctgcttctcctgatctgggtttatccacacagcctcctggagtgcctctgggctccagcctgaggacctggctggttatcagtgtcacacagctgcatcctgactccatgttaccaagggttcctgttccatgtggaaatgatagaaagatctccccactcatcctgtctccccatccctcctttatccctgcctgtgaccaacaccagttcatgccaagacttcagctgtcagttgtgttactgaaagcagagcaagggttcagggacgataactccttttcttactggtctccccagtggaaagagaatcagtttgtttcaagaagtaaaataagctgcccacacatggtgggtgaggatgaggtggaaatgacaagaaagaatccagcctggctgggcatggcagctcacacctgtaatcctagcagtttgggaggcggaggtgggtggatcacctgaggtcaggagtttgagaccagcgtgagcaacatggtgaaacatcgtctctactaaaaatacaaaaattagttgggcatggtggctggcgcctgtaatcccagctactcgagagactgaggcaggagaatcgcttgaaccagggaggtggaggttgcattgagctgagatcatgacactgcactccagcctgggcaacaggcagagactccatctcaaaaaaaaaaaaaaaaaaaaaaagaaagaaagaaagaaaagaaaaaaggaaaagaaagaatctaggcagtgtgacccagaagtccaggagccttcggcctggtcccacaggtgtcccctcctttttgaacaggtatgctggccatttgctgagctctgaaactgtgggagtgataacaagaaaggcgaatccagcctgtgtgacccacagatgtgagagaggtagtctgatgcttaagaaaaggtgggatcagccttctgaaaggtctggatctggcttggcctagagctggtgtagaagagaagcaagagagatgcttagccttgggtggcccaggcccagctgtcctgtcaaggggctgagctctctgcaacatggaaatcctgcagagccatccttgggaggctgtgatctcagtaggatgcaaaaatgctaatggaagtgagcaggggatggtttatgggggaatgaggggacggtgtggggtcaggtgtggtaaggagggtgcaccctgaagaggagagtgtccattgtgactcacaggaggaggaggcccggggcccagagcagtgacaaaaggaggacctggaaggacctgggccctcaagacacacagagactggggttttggtctgtccctgagggtccctcaggaggatcacataaaaaatccatagtcagtgtcctctgtccaaggctcactgtcccagctgttgtccctcccggatcctctgggtgtccacatcctgtagttttggacctgttcttctctctgccctcaacctaacagctgatggggcatccaccaggaagcgcatccgtgggcagggaggaggccgtgggcagccttgtcctgtatgtgagacactgctcagactcggtgaccccctgttcattaacgtgggaggaaaggaaaacaaaattcactgtgaacatctatacatcatcaaagaaaaagcaatgagaaaaaacaggaagtgaagcccagctctaatagtttatttctacttggaaataaataaaacttaatatgcctgatgtgttatgtaaatacaacaaacatattttaaaaactataaaaattatgtaaaggcacatggcttacactaaaagaaacatttaaaataacaacacccttgaaatgcaatcccaaaacacagcatacattttatttcagttccatgtatggactggttttatttaaatgtctgtattaggtttcactatttggttgtttaaatggagcatttaaaatcttattgtattacaacttatatcaacataatcatcttgctgtttttctgtatccccttaaaattccctaaacaaatatttattaagagcccagggtgtatcatgccagaactcaggcagtcacagacataacctgtttcatttttcattttgatcaacagaattatgttttctgttaagcttgttgtttttagttcattagattctagacgtcattacagatcaaagacgaaaaatttctatcatctttaagccacccccacaacactcactactgaatttgaaccaaaatcttctcctagaaatcctcgttggcggctcgatagtaagagctgccatgtatcaggctcacctgaggacagacgctggttaaaccaagttgaagttttaattcttcccatcttcaaagactgagcatctttgctctttttgctcataagtgaaacactccaaagtcatttgccaggatcccctgtagatgggcattcagtgtacagactcctaggcaagatccctggtcacagtatccaaatgactttgactgcaaacctggggaagtagagagagaacaaagatttaccagaaaaaccctctgggaatgtcttcccaaggcaccctagagggaagagctccctttctcttcagctccacaggatccacagaggaaggagagctctagccagcaggaaggagccacatgagaggagaggaccaggtgtcccacacaggtggggaagtgagtccatggggctggtccccgctctgggcttgatcctgacataagaggactctgtgtagacaccacctgagtcctctgcaatgtacagccacagagccatggacagattcactcctgaggagtccagtagagcgcgaagactgccttgaggtcacagcgggaagacacaggtgtcacttgagctggcctggacctgagagagggggcagtggacagaacagaggggaggcagtggtgtgaatgagaggctctggtcaccttatcatagaatggtttaccttggctggacaccaggggacgctgggggaccatttctgagaagacgcgcggggggcgggggtgggcggtgatgggagcacaaccggccacctgttgtgcctgttgtcctctgctcagggctcacaactgtgttctccccaccctctgggaccacagagctccacccctgccacaccctgacatcctcaaggcaaggagcctgacccagggctcagggtggggtcacaaagctgggggggtctgatttgcatggatggactctccccctctcagagtatgaagagagggagagatctgggggaagctcagcttcagctgtgggtagagaagacaggactcaggacaatctccagcatggccagcttccctctcctcctcaccctcctcactcactgtgcaggtgacaggatggggaccaagaaaggggccctgggaagcccatggggccctgctttctcctcttgtctccttttgtctcttgtcaatcaccatgtctgtgtctctctcacttccagggtcctgggcccagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggtcccacagtgctccaggccaatagggaactgagacaagaacccccttcctcctctgtcaggagggtgagccccagcagctgctgctcaggcctggcctgtggcttctgctgctgcagcttccttcatgggtccaggggcatccagggccctgcctgagagtggaggctcctcctccccttcagtcctcagagtcaggaacaggacatccaggaaacagaacatcctcctccctgcagcttaggacacagggtctctgcactgaagtcctgggctgaggtggcaggtccagttgtgtcatctcagacccacctctgatggggaacccgtgtctccgtcatcctccttttcccatttccaggagtttccagagtggtgtcttcctccccctgctcctcagtgtgaatccctgtgcttcctttctctccagcctattcttttttaataaaactcctttcatgtaggaactatgcacatctaataaactacccatatttataacaggaaattagacaaattttggcatttttctggttccttgaaaacatcaccatccccgggagctattgtgaccatcccggcagctcctcatgatgcttgtctcctccctccctcccctaatggcctctcaggaagccacagatctgcctctctcactactgtttggtttttttttctggaatgtatcagtgttatcaaacgttatcttcccatttgttcaggcttctttcactctgcacacttgctttgagattatccctgctgtcgctgaattgcacccatcccttagagggctcattactatctttaagggtccttaggccatttttttctgattttattcatgtatttcctttaaagtttgaatttattgttcatcaaacaaactctatgggtgatgttcatctaaggtgacaggacagtccgtgatggtttgtcaggattcttgcttcttcagttcttttcttggctctctctatagtggaagaggttctcatcttttatttatttatttatttattttggggtttttttaagggttttagcgattttccctttttaattatttttaaaatttgttattttattttaataggtttttggagaacaagtgttgcttggttacatatataagttcgttagtggtgattcctgagattgtggtgcactcatcatccaagcagtgtacactgtatccaatgagtagcctctcatccctcacctccctcctatgctttcccccgagtccccaaagtccattgtatcattgttatgcccttgggttctcatagcttatctcccacttatgagtgagaacatacagtgttttgttttccattcctgagttacaccagttagaatgatagtctccagttccatccaggttgctgtgaatgccattattttgtttatttttatggctgtgtagtattccctggtatgtgtatgtatacatcacatttgctttacctacttgttgatttatggacatttgagctggttccatgtttttgcaattacagattgtgctgctataaacatgcgtgtgcaagtatctttttttgtataatgacttctttttctctgggtagatacctagtcgtgagattgctggatcaaagggtacgtctatttttgtttccttaaggaatctccacactgttttccacagtgattgtactagtttaccttcccaccgccagtgtgaaagtgttttgttttcaccacatccatgccaacatctgttatttttttattatagctattcttgtgataggaaggtggtaacacagattgtggtaccgatttgcatttccctgattattagtgatgttgaacatttttctatatgtttgttggccatttgtacaagttcttttgaaaattgtttattcgtgtccttagtccaccttttgatggaagtgtttatttttttcttgataatttgagttcttcgtacattctagatattagtcatttgttggatgtatagattgtgaagattttcatccactttgttggttgtctgttaactctgctgattctttcttttgctgtgcagaagtttttttcgtttaattaagtcccatctatttatctttgttcttgttgcatttgcttttgtgttcttggtcatgaaatatttgcctaaaccaatgtctagcaaggttgttctgacgttatcttctagaattcttaccgtttcaggccttagatttaattatttgattcatcttgagttgatttttgtataaggtgagagatgaggatgcagtttcattcctctacatttggcttgccaattatcccagcaccatttgttgaatatggtgtcatttttctactttatgtttttgtttgctttgtcaagcatcagtgggttggaagtatttggtttcatttctggattctttattctgttcctttggtctgtgtgcccatttttatatcagtaccaagcagatttagtgactatggagtcaaactttactggagtttgaagctgggtaatgcgatgcctccagatttgttccttttgcttagtcttgctttgtctatgcaggctctttttggttccatatgaattttaggattattttttccaattctctaatgaatgatggtgatattttgatgggaattgcatagattttgtaacttgcttttggcagtatgatcattttcaatgtattgtttctacccattcatgagcatgggatgtgtttctatttgtttgtgtgtgtcatctatgatttctttcagcagtgttttgtagttttccttgtggaggtctttcacctccttggctaggtatatcctaagtatgtattttgcagctatttgcgaaaggggttgagttcttgatttgattttcagctcgtttgctgtcattgtataacagagctactgattcgtgtgccttaattttgtatcttgaaactttgctgaacttatttacagttctaggagctttttcgatgagtctttaaggttttctaggtatatgatcatattatcagcaaatagtgacagtttgaattcctctttgtcaatttggatatctttgatttgtttctcttgtctgattgctctggctaagccttccagtactatgttgaatagaagtggtgaaagtgggcattcttgccttgttccagatctcaggagaaacgttttccacttttttccgtttaatataatgttgactgtgtgtttgtaatagagggcttaatagaggacataagttatgtcttttctatgtcaattttgcaaagagttttaatcatgaagtgatgctggattttgtcaagtattttttctgcatgtattgagataatcatgtcatttttgtttttaatgctttttatgtggtatatcacatttattgactcacatatgttaaaccatctctgcattccctggtttgaaaaccacttgatcattgtggactatgtttttgatagctgttggatacatagaataatttaggaaggagtccccctttttccttcctgtggattaatgcattagtcagcgttctctagagggacacaaataatggaatatatatatatgtttattaagtattaactcacatgaacacaaggtccaacaataggctgtctgcaggctgaggagcaaggagagccagtccgagttccaaaactgaagaagttggagttccatatttgaaggcaggaagcatccagcatgggagaaagatgtaggctgggaggctatgcccatctctcttttcatatttttctacctgcttattttctagccatgctgtcagctgattagattgttcccacccagattaagggtgagtgtggctttcccacccactgacaaaaatgtgaatctcctttggcagcaccctcaacagacacacacaccaaggatcaatacttttttttttttttttttggagatggagtcttgctctgtcacccaagctggagtgcagtggcgcgatctctgctcactgcaagctccgcctccagggttcaagcaattctttgcctcagcctcccgagtagctgggactacaggtgcccaccaccatggccggctaatttttttgaatttttagtagagacggggtttcaccgtgttagccaggatggtctcgatctcctgacctcgtgatccgcctgcctcggcctcccaaagtgctgggattacaggcgtgagccactgcgcccggccaatactttttgtccttcaatccaatcaagttgacgctcagtattactcatcacaagtccactccttgtcagcatgaacccatatacaacttgtgatatcgtacataatcttcaaataaagacaataataaagtcataattacgcctaacataatacaattatccttcatacaaccagaacgcacgaatccctaacacaaatactattacatcaagttactgatacttaaatgctgatgtgacgtcaataaatcttatgttatatgacaaaggagaaaggaaataaaatgaagatattttcttagtacgagtttatagatgcgcaaacatgtttttaacaaaagaaggaggaaatactcttgacaattacactcctcgtttctgccgctggccatagctggtattgatgactaccttcttctactacccattctgtattccctttgccttcagcaagcacctcagtaggttgtgttttttttcctggtggagtgacccaaatcttcattcctgaagggtcccattgaccttaatcacagggcatggtaatagcaagaaatgccctaatgcatctcctgtattccatgcatgttcttcagtaactccattgtggagtagtaaactgatttcattttgatagtctgggtcaatcaccccagccgacactgtaactcccttcttagccattgacttaaaggtaggagaagcccaaaatgtccaggtggcaatcttaacttccagtttaatggaatcattgttgtgtctccaggtggtagtgttccttcctctggaagtaaatcctttgagccagcagaacataatgtctcaggaacaggaagcaaaacatttgctagtggatcactagggttgatggtgagtggtgccacttccacttccaccccttgattcctggatccatgaatcctggctacaggagggacagtaccatatattggatgctgatttaaagcatacacagccatctggagaactttgccctggccctgcaaagtattgtcacctagttggcaatgtaattgtgacttcaaaagccattccactgttctatcaatccagctgtttcaggatgatggggaacatggtaagaccagtgaattttgtgagcttgagcccactgctgcacttctttagtcataaagtgagagcctttgtcagagcattgttgtgtggaatatgatgacagtgaatgaggcattccaagagtacacggatggtagtctcataggcaaaccaatatctaggataagtgtctatttcagttaagacaaacctctgcccttcctgtgatggaagaggtctgttgtatttctcctcacacagggcaccagttgagatattgctcctcagaagacagcattagctgcgggggtctgcctgcagaccctgactcaaacgacggatgaataaaaacggacactgacacacagatattctgtttggccagtccggctgggttctttgattctgagtgtccgacaacatacacaccaggagaggtttgtcactgtggtgggtcctgagcagctggtactccaggcatttatttagtatacaattaacaacagaagctttgagtaaacacacttgtggataattaacatggttaagagagtagttctacgaatgattaaagctcaggtaccctggtctaaagtaaataccattacggggcaatatccctggttgacctcccaccgagagggccatctggctcaaaggttagttaatggagatagggtaaacaggcttaactgggaaagcctccattgtccctagcatttaccctatgacctaatgctctaaggtaagaaccagctgccttcagcctgtacaattattacaagctatgtaacattttagccttccaaaatgtttgtgattattccctataactttccctaatatttccctttgatatttctgccaccatcctgagtgaatcccaacagaggtccaatataatcaacctgccaccaggtagctggctgataaccccaaggaatggtgccacatcaagggctcagtgttggtctctgctgctggcaaattgggcactcagcagtggctgtagctaggtcagccttggtgagtggaagtccatgttgatgagcccgtgtgtaacctccattcctgccagcatggccacttccctcatgggcccattgggcgatgacaggggtgtctggggaaagaggatgcgtggtgttcacagaactggtcatactctcctcttgattattaaaatcctcctctgctgaggtcacccgttggtgagcgctcacatgggatacaaatactttcacagtttttgaccactcagagaggtccatccacatatcttttccccaaatttctttgtcatcaattttccaatcatacttcttcctagtccctgtgacagttactacaggacagaatgaagggggactaacacagaaatgaagacaaagacaaagggatctgttttaaagaaggggtcagggggctccttgcttctagtgagcaagggccctgagctactgcaatccttcatatttattaggtagaaagaacagggaggaggaggtaacagttggtcagctgcttgatttatcacaggttcacaggattgctttctttatacaacatacttcagatgtgctgcagataatcaaaagaaacactgtgcttggggcgtgacggctctcagcattcgttctggtggtagatgcagtttgtcgtttgccaacaacctgcattcatgagaacagcttgctgtttgctccagtggtatactgagttggtcacgaccctcattctttcggcctccaagaagtccctgatcgtccagccaaaccgttgactacagcaaataaattcatatataatcacacatctggagatttctccttccatgcaaagagcacaaccaggtgtgctcctcaaagttctgcccaatgggaagatttcccttcaccgctgtacttcagggatgtcctggaaaggggctgtagtgctgcagctgtccactttccggtggtgcctgcatatcatgcagatacatttgtgaaccaggccctagtcttctttctgtcagctgatcatagtgaactgcccctgagaccaccagtgcaggctgggggatagtgcaggctggtggcaggagtggaggtcatggacatttgagccacttccccatgtaacttacttgtgccttcagcccaaatacgtatataccacttccactgaatgatggaatgctgctgtgcatgatccactttatggctaaatgggttagaaagcacccacttcatgacaggcagttcaggttgcgtggggactttaagacgcatagtcaaatgttcagtttccaccaaagcccagtaataggccaagagctgtctctcaaaaagagagtagctacctgcagaagatggcagggccttgcaccaaaatcctagaggcctccactgtgattcacttacagtggcctgacaaagactccaagtagctttgctatctgccgctgacacccaaataccattgggtctgttgggtcatacggcccaagtggcagagcagcttgcacagcagcctggacctgttgcagagccttctcctgttctgaatcccactcaaacctggcagccttttgggttacttgataaatggactggagtaacacacccaaattagagatatgttgcctccaaaatccaaataggcccactagccattgtgcctttcttggttgtaggaggggctaaatgcagcaacttatccttcaccttagaaggaatgcctcgacaggccccacaccactggacacctagaaattttattgaggtagaatgcccttgaattttagttggatttaccgcccatcctcttgcatgcaaatgtctcaccagtaagtccactgtgtttgctacttcttgcccactggatgcaaccagcacaatgtcatcaatttaatgggtcagtgttatatcttgcaaaagagacaagcaatcaaaatttctttgaataagattatgacacacagctggagagctcatatacccctgaggtaggaccgtaaaagtatattgctggccttgcctgctgaacgcaaattgcttctggtgggccttatggaccggaatggagaaaaaggcattttccaagtcaatggctgcatatgaggtgccaggagatgcattaatttgctcaaacaaggaaaccacatctggtacagcagctgcgattggagtcaccacttggttaaacttccgataatccactgtaattctccaagatccatctatcttctgcacaggccaaatgggagagttgaaaggggatgttgtgagaatcaccacccctgcatttttcaagtccttgatggtatcactaatctctgcaatccctccacagatgcaatattgtgggtttatttttttttaataaagtttcactctgttgcccaggctaaactacgatggcagaatcatggctcactgaaacctccatctctggtttcaagcaattctcctgcctcagcctcccaagtagctgggattacaggtatgtaccatcacaccccacgaattttttgtatttagtgtagatgaggtttcaccatgttggtcaggctggtctcgaactcctgacctcaggtgaggtgatccacactaagatccagcttatgtggatcttttctcttcttttcttggttaatctcactagtggtatatataattttatttatcttgtctaagaattggtttttgtttcatttatcttttctatcatttttttgtttcaattttatttagttctggtctgatattgctatttcctctcttctgctgggtttgggtttgcattgttcttgattctccatttccatgaggtgtaaccttagattgtctgtttgtgctctttcagactttgtgatgtacgtatttaattctaaacattcctcatagcactgcttttgctgtatcccagaggttttgataggttttatcaagatttagtacaactgcaaccttactattggccaacggcttttgaattcctaagagtgtgacctcatttaatcctgacaacagctttatgattgcttttcattcagtaggtcgtgattagagagggagtgcttgtggcctggatggaaggttctccagtttatcaaataaaaacaccgaaggtcagttaaatttgaattcagtaaaacaatgacaaagaattagtatgtgtaactcccacacaatattgttcatttgagatacaaacttaccttgtagttcatctgccaactgcacacagggttcaaagcctggaagaggcagagttagagctggtcttctcttcctgatgccaggtctatgagctgaacctcaaagacagggcttctctaacacagctaccctcaagtaagcacatcggttagcactaaatacacagtatacgatgcccaatcaataatgcctactcacttttctaattcttctttctattattcttcaaatctgcagactcaagacctcccgaaacattgcggcagccaggattttgaatgagggtcctcatatgtctttccaaacaagatgcaagggtgctccttggtccctacacagaggggcttaagccaggagtgcataagtaacatgtaagagacagaagaactcaacctggctctccctctgtgcagtgaaacacctaattccagggttctttgattctgaaggtgggtgggctgagagaaagaggagccccaccctgagagctccgagtattcaggacaagacttggcagcctgaataggggctatactcttgagtgtggaagaagcaggcatctctgggcacaggctgcttttctggtggcttctccttcaccaaactgggctccctgctgtgatgtctatcagagaatctccttcagtaagaccaagattccaggatttaactaaaaatagcagcacagaccagaaaggtatgtcatggtacttgaattctgtgcagagcaataagtacaaatgcagcttaacaggggccttcagagttgtatctttggtgaaggagaaaatagacaatggcagggagaaactgaaggactcagtaggtctggaactggggcagcactgggtgctataagcttgtccttcaggggtctacagatgctgacacctgggaagtcatcctgcatcatctgctcactgctcactgggctcagcagctatgtcctcacaaataaccagattcaatcaacctggccttctccacccaacctggggaatgtattccagtgactgtttcaactgaggttctatgaaggggttgggggataagaagaggggactgatttgcttgaagaaaccattgcacaccctttcctttcatctaaaacctattaatggaaactctgaggccacccatagaagtctagctggtcttctaaatttgggagttacgaaggagtcattcctgatcaatctacaggataaggggccatcagcagctggtggtcagagtgaggaagaaaatggcttccttgagagactcatcagcacagccaccaactctggggaaaatggggcacttgctataacagtcaccccaaactactcacaggagcctgagcctcgtcccctcaccttattgtttctgattctggtccatgcctctgttttccctggacccctcgcccatgtctgagtccagggtagcaggggtagttccatcccagtcaacatctatacagaagtaacagctgctatggcttgaagccgagtctacagttctacccatgagggcctctttttctccccaatcccctcacacaggtgaccagtgctgtgggtctggtggagtggccactggccactggtcccaggcgaacacaaagtatttattcctctctaacaccaggcatatattggagggggtttggtgggtgtagaacagagtggttcttccagatgcaaagcagtaagaccctgtctacagaaagtcatttcacaaacctccacaccctttcatgataaaaacgctcagtgaactatgaatacaaagaaactaccctaacatagtaaaagctatctatgaaaatcccacagtcaacatcacacataatcttaaagaccaaagatatgtttttgtaatatcaggaacatagcaacaatgtacacttcactgcttctattcaaaacagtattgaaagtcctagccacagcaataaggcaagagaaataaataaacaggataacaattagaaataaaaagtaaaactatctctgttttcaatggatttaatgtcatatgtagaatacccttaaaagttccacaaaacagcttttgtcagaatgattaaatgtattctgtaatgttcagaatacaaaatcaccatgtaaaaacacctcatggctgggcatggtgactcacgcctataatcctggcactttgagaggctgaggtgggaggattacttgggatcaagagttcaaggacagcctgggctacaaagcaagagcctgtctcaagaagaaaaacgaaagaaagagagaaacaaagaaagagatagaaagaaagaaagaagaaagaaaatctcttatatttcaatacttagaaaatctcttatatttcaatatttaaacaaggacacaggaaaaaacccaaaacaaaattaataaaacaaatcaaattgcaacatcattagagagagtaaaatatggctgggcacagtagctcatgcctgcaatctcagcactttgggaggctgatttggacggatcatctgaggttagaagttcaagaccagcctcaacaatatggtaaagcctcgttcctacaagataaaataaaataaaattgctagctgtggtggcacatgcctgtaatcccagctactcaggggtccaagtcacaagaattgcttcagcctaggagggagaggttgcagtgagccaagatcttgccactgtactccagcctgggtgacagtgagacattgtctcaaagaaacaaataaataaaaatgaaacagtaaaatacttaagaataaagttattcaaagaggtgaaagacttgtagattgaaaagtataaaacattactaaaagaaattaaagaatacacaaataaatggaaagaaatcctttgttcatatactggaaaactcagtattgttatgctaacaaaacaaaccaggaggaattgacagattcatttcaatctctgaaaacattccagtaatattttatgcaagaatagaaaaaaattaaacctaaaatatatatagagtatgaagggaacctaaacagtcaaagtcatcttgtaaaagaagaccagtgttggaggtctcacactttctgatttcaaaacatactacaaagctacactaatcaaaacagagtggtatatatgtaacatacatactgacaaataaaatagaactgagtgcctagaaaaaaaactcttagttatacagtcaaataattttaaacaaggttgtcaagacttttcagtggaaacagtacagtctttcacaaatatagacgttctgggaaataatactgaatggcttttgctgttgttgtttttgaatggtctcaaatgttctctcaaagatgctgcagaacatagcttattgattttgtaagttaaaaggctgagtaagactgtgagagactccctgctcatcatcattcttcttccacttccagtgactactcttatattctgtgccataagccaacagctactgaccccaggatcttttaatccttctgtaaaactgtcattaaaaaaaaattgtctaaagtaaattttttaaaaaattctcacttaaaccagctgtttatccaatataaggctcaacacaaatagttacagaaagccagtaggtcattaaaacaattaatttagtcattcaaataaaaatgaacaccatgtaacactaatatcaaattatagtcacaggggcaggatttcagcaacagcaagagaaagtagcacaaataggaatgagcaaagaatagacaattaatgagtgtgaattggcctggaaaatattgtggcaatgtccaaagataaatccacagttatttgtgaaacaagtgaaagaccacgcattctcagtccaggaaagccaccagggggtggtctgggtctcttgaactgtaagaagctcaagaggtccaaacttcatgaaccctgcacaggtgctcattgactcatgtaaacgttagagcagctgcttcctcccacaggacaaatccacagcacacagcctccctgggctggcccctcacagtgtagctgctctcaggcctgtggacccaggtggtgataaaggcagtaaagatttgcataaagcagcacacagcacaccccctccatggagagagctcaataggagataaagagccatcagaatccagccccagctctggcgccaggggtcccttccaatatcagcaccatggcctggactcctctctttctgttcctcctcacttgctgcccaggttaagagagatttcaaataccagcctttggagggatccttctgtctgcccttctaatttctaacatgtgtctgttttttgtttcagggtccaattctcagactgtggtgactcaggagccctcactgactgtgtccccaggagggacagtcactctcacctgtgcttccagcactggagcagtcaccagtggttactatccaaactggttccagcagaaacctggacaagcacccagggcactgatttatagtacaagcaacaaacactcctggacccctgcccggttctcaggctccctccttgggggcaaagctgccctgacactgtcaggtgtgcagcctgaggacgaggctgagtattactgcctgctctactatggtggtgctcagcacagtgacagactcataagaggaaccaagacataaacctccctcggcccttgtgatgtggagattgtgtgatcatacacaccagctctcaagacagcctacatgtggaccagccatagaaaggggaaggaaagggtctgaattgatttctatccctccttgtgccctgaagtggaggaaatgtgagagtgatttgcagtaattgaatgagacaaagcaaaagttatttgttttatatgaaaaaaaaaaacagaaacagcaggatcagatctaaaggctgagtctaaatgcatttcctccagacagaagcttcttcaaacgatgggctttctgagctaagagcaaagaaaataaactctccacgggtatattattaaagtttattttattgagttactttcaaagcaatccatgactattatataaagtcagaaagtattaaaaatcaccaagttctctgctaagctaccttatcccatgcaatcaaaataagtacttttcttcatttggatgcattttttatttctgtttttaatatttccacaatggtgattaaacctggtgctcattcctctggtttgatccacctttatgctcttgtcatttaaagttaatgtaagtagtgttccatttatttaaaaggataaaatattttaatagttgatcattgcattttgaactgagtaccagtgaagtattctagcttttaggtaatttcaattgtttgctagtcaatgatgttatacgttgttgtcattaaaccattcctggtcatttctgtggattttgtgaggtcagagaaaatgtctgtgcttttcaatggaaagccttgggtacattattcctgacttcccaacgcacaaaatagagaaacacaaatttcctgctcatgttagttagagcataagagattcaggtacgaggaacaatttataccccaaactacatacagtgtcttcaggcatgtattagaagtgtacttctcaaactctctgatacccttagttctgaagaagctcaaagttggctaatacttttatatttatctttttattttttttacctcagccagcactttctcctgattcctggggttttctgcatttccagtgaatccagtgaatcacacaaataggctaactgattcttcccaaactccagcactctcccttatgtgctgatctagtgaggaatcacatgggaagagagacccatggatttctggcggcctgggaagtgagttcatggctggcctcagcttgcaaaccagacacttgtctccttgtttccctttactgttcattgggttcagcagctgtgtccttccaggtttcctggacagtgatggaccacactctcccaactcccaaccacccgctcctcaaaaggaataaccagactcagcaacttatgtgaggggcacagccaggggtcaggatagattggcattaagtcccctcaattaagagaggccagggaaggggggctgttccccctaatccgtgtggctcaggaagcagagctctagagacatctctaccatggcctgcaccccctcctcctcaccctcctcagtcgcggcacaggtggctggagacagggagtcagggactggcactggcaggaccagggctctgctttgctcccctggctcactgagctgcctccctcaccctgtgtctctctcccgactctcagggtcccgggcaatcatggctcatcaggtaacctgcaccgtctgtctgtggctaaaccagccaccatctcctgaactggaagcagcagcaataaggttcttggaattgtgacctggtgccaacaatgaccaggaagtgcctccaagcttctgactcatagaagtaaatatctgcccgcagggattcaggacagacgctcaggctaccagtcttgcatgaagcccttcctaagcatctctgggctttaggctgaggacaaggctgatcactcctgttggcttcagacagccccctggaggtccaaacagtgctgcagtctgggaaagtgagatgagaacacgccaggtctcctaggagcatgaccttccaatggcaccacccacaaccaggacagctggtctgtttaccatttgtgtggatgtttcttgatgctgccgctaaccagggcccaagacttagttcggggacagtgatctagagaatacagctttgttctctcacagccagccctcagaggaagcccttagcaacagcattgtcagactgcctcaaaaaaatcagtctttgattccaggaacaggctgccctggggacagactcaagatgagtcagggtaagcagggacagaatccagctgggtctgcctcaggcatgtgcactaacgcaaaggtctgttcatccttattgtctactaaacacctattatgtgccagtctcaggagagtgctcaggatacagagtttacaagacagacagggttcctgtctttacagggataatgcctcacagaagagtgagcaccaacaaatcaatgagaataaggcatattgtgaggtataaaatggttgacatgggccagaagacagtgagcaacaagaagctattaggaggttgtaagcaaggagatacagactctggtttgagattcaggaggcaaagtccagcttctctaaggaagatgaaaaaggaggggacagagtgaagaaagatggtccagttaggacatggtggctttgtacacatgagagatgaggtttctggcaagtaatgtggcagctgagctgaggcctgtgctgtggatcccagacgggagccacctgctaggcctaggctggagccctctgcctctgctcacgaggaccagcagctgtgtccttacaggtccttagggagccacagaacagccccaccctggtccaccccatcccaggctcagctttctaggcaagggtcagagtcagggcctagggtgggacttggccagcccaggggaggaggctggtgtgcatgaagagaccctccttcatcctgggctgctggcgaaagtaatagggactgggggagctcaagcccagctgagtgtcatcaggatgcagagctgtgtgtgggtccccaccaaggcctgagctcctccctttctcccccttctcattcactgcacaggtaactagggctagggatcagggctgtgggtgaatggaacgaggaccctgcatgctgccctctcaactgacccacctctctcaccctctgttagtccaggtgtcaaggttctgggcccagtctgtgctgactcagtggtgtgaagagttcctgtgggtggggtaaactgccgccatctatcacacttgaagcagaagcaaggctgggtgtgggcctgtgtcctggtatcagcagtgcccccaaactcctcatctatgacagcagtcattggtctgcacaggtcccagcgaagttctcaggtcccaggttggggatcatggcatccctgagcatctctgggctccaggcagagaatgaggctgattctttcgctcatcttgagacccaaggatccatgattaggcagtgctgcaggccagtgggtagctgggaggaaaaccttctgtctccccagtaatgtgtcttccctcttcagcctccaccccttcagcacaagtttctggggaggagggtctgaagcccgggtgagaaaaagggtcaaggctggccttaggacctggatgggcacagtgaccccctgctgagagggccttcatgagcaagaaggctgggggaggtcctgagttgatttttacaatggaaacagacaccagctccccatccttgttcaaaagcatctcaggaccttttcctctgcagatggcaagggggagaatctccctctgagatacatgagaattcccttcccatgacctgtcctgtcacctggatgaattcgtatttggaaaccaaatgactccccagtgccaggcattacatcctcacagaaaacctgccagaatgagcaagatcttccctccctgacccactggccaggaatctcggacatcaggatggctggactagatcactcatgccatctcccctgacatcatcatggttaccggggggactctctgattaatttgggccacacagtgcctgtccctggcattgcagttggggacgcttacaggctaagtttatggctgggagacctagggtctagaaaggagaggaatagaacagaagctttgcctacatggccccctgtgtgcatcactcttccctccacctttatcctaagttcatgatgggtgatgtctccttgaggctggaacctgggcagtgacatgggcctgtgtgtcctcatctcacaatgcttcatcttgggctccctgacctttctgatattcctataatggatcaatttcaggctaggacacagccatgcccatacaggaggcagtgatctgagaatcaggtagtcttagaagagacagaaagcaaataaacaccctcatgttggcctcctaagcccagaggacataaggaaatgaaaggaattcaagaagaaacataagtggtcactgcccaccatcacctgggcacctgttctccacctgcccctctctcagtgaggaccagactcagaggcctagagaaacacgtcttcatctgttcacaccgtggggtgcctccttctggactcatcccaagactgctgctcccccagcttacctgtgtaactgctgagagtcttcacagggacctggtcacagggtttgggatcaggatcagcctggctttaactcagctgtgaccctgccccttcaggacaaaaagtgaactattagggctctaactgaactctcctgatttacttaaatcttatattctccttctcaatatccttctaggaagttctgtctctacccaataatgtcaggtcatttcctcaggcctagagccatttgatttccagacttctatactcacacttatgctctcattctctgtcatggttcatttactacgcagcagctaatgaggccaaccatgtatctacagcccattgacatgaaaaatggggaggagagggttccttagataaatacagggttagcaaaggaaagtttcttaggaatcacttcaggatccaagaaaattcattccagagcttcgagagtttacaactcaaaaacaacagcataatatatgaggtggtgaatcttcttggccttctcaatgaataacctcagaaatggtcagagaatatgcttcaaaaaggtaagagtatgactttcacaaacatatagtattcacatatgtcaacaattttaattggtttatgtattttggagaaaaacagtatgatgataaataaatgttaaaaagcatttttaaaaactcagtgcttatactccaccaggatagaacctgtgaaggaaatttctgtgttgaagatacactgtcttttagaataatagcaacatagctatgaattttgtcttctcatctcacaatctacaaattaaaatcaccccatttatgtgaaatatctagaaaaatacaggtacatttggacattcccatctgccaccacccatccatcttctcctaaagtggaatccctctgcccccattctgctcctctccacacatctacctgctaacacgtgactcctccctgccttcctttccagatccctagcagattgggcccaccaggggaacaagctcttggacctggggatcaaaagtgcatcttgttggacttctgaggacttgccctgcaagggtctctttctggatcacaatccctctgttcctgggcatccccttttgctggatcctgttatttatctctgtgttactccatctaggtctactctgtggacttccctgcatcttcacctgaaccccaggaatcttcaagtcatgccaatattccctcagttctcctgaaatgtcttattttctcttctcctgagatcccaccaagtcatcccttctgagacccctgagtgtagcagggccctctctggtctctttgcttcaattatgaatgaggagaatgggaggtcctctttgccgctcctacccctgtgttgccatcaggatcagcttcatgaggcagaatgaggctgtctagatcaacatggctttcccaacattgagctctgtgcccagcacaaggtaggtgctcagtaactatttgagaaaacctacatttcatcacactggccacattacactgagtccaggatggggatgaactgggagaagcagtggtggaaatattcctctctctgctttcaggctaagaactgatgggacgttcaccagggagagcatcccttggcagaaagggggccatgggcatccttgtcctgtatgggagacactgctcagcctgggggaacctctgttcatgaaggtgggagaaaaagataaacaaaattcactgtgaatgtctatgtatcatcacagaggaggcaatgacaagaaaataggaagtgcaagcccagttacaattggtttctactttaaaagaaataaaatttaatatgcctggtgtgttatgtaaacacaacaaacatttttcgaaaactataaaaatatttaaagtaacatggtttacaataaataggaacatttgaaataatgacaccctggaaatgcaatcctaaaatacagcatacattttatttcagttatttatcttgactggttttatttaaatgtctatattagagatcactacttcattgtggatttttgtttgtttgcttgtttgttgtttttgagatagagtctagctctgtcacccaggctggagtgcagtagcacaatctcgacttattgcagtctccagctcccaggttcaagcacttctcctgcctcagcctcccacgcacctgggaccacaggtgcgcaccagtatgcctggctaatttttgtgtttttagtagagatggggtttcttttttttttttttttttttttgagaccgagtcttcctctgttgccaggctgaagttcagtggcgcaatctcggtacactgcaacctctgcctcccaggtttaagcaattgtcctgcctcagccttctgagtagctgggactacaggcacccgccaccatgcccagctaattttcacatttttaatagagatgggatttcaccatgttgcccaggatggtcttgatctcttgacctcgtgatccgcccaccttggcctcccaaagtgctgggattacaggcgtgagccactgcacccggcctaagatggggtttcatcatgttgaccaggatggtctcaaactcctgacctcaagtgatccactcacctcagcctcccaaagtgctgggatgacaggcgtgagccacagtgctcgacctagtacattgtttaaatggtgcatgtaaaacctcatggtactacaactgcctggtgacagactcaccagagtaaataactatcctgctgttctccaaccacatgggattgccccaaaaaatatttgttgaatcccaggtgtatcatgccagaactcttgcagtcatatatacaatctgtttcattttaataaataggattatcttttttcttcagtttactgtttttaatgtatcatattctagatttcattacacatcaaagatgaataatttctatcatctttcagacatgcccaaaacactcattagcgattttgaacagtattctttcctaaacatcctagttggaatggttgatcctaaaagctaccacgtgtcaggctcacttaagtacagactctggtcaaaacaagctgaagttttaactcttccatcttcaaatactgagcatatttgcttgttttgctctttagcaaaacactgcaaagtcatttgccaggatcccccgcagattggcattcagtgatggagaacagactcctaggtgagatccctggtcacaggatcccgatgactatgactgcaagtctggaaaagaagagacagaacaaagatttaccagcataaccctctgagaatgtgccccaggcatcccggagggaagagctccctatcgacccaggactgcagaatccacagaggaaggagagctctggccaccagggagcagccacacgagaggagaggacccagtgcccccacaggtgaggaaatgagtccatggggctggtcactgctctcgatttcattctgacataagaggactttgtgtagtcaccacctgagtcctatacagtgaacagccaaggagacatggacagattcacccctgaggaacccagtagaatgtgaagtctgccctgagctcacgaaaaaaatgactcagggggctgcctggcctggccctgatggagggggccatggacagaacaacggggagtgaggggtgtctctgagaggctctggtcaccttgttatacaatggtggtgtacatgaccaaaatggacaccaggggatgcctgcgtaccattactgagaagactgggtgtgatgagagcaggaccagcgccacctgtcctgcttggtgccctatgcttagggcttacagatgtcaactctgcaccccctgggaccacatagccccacccctggcactctctgacatcctcaggcagaggagcctgacccagggcccaaggtgggatcagaaagctggagggtctgatttgcatggatggaccctccttctctcagagtataaagaggggcagggagagacttggggaagctctgcttcagctgtgagcacagaaggcaggactcgggacaatcttcatcatgacctgctcccctctcctcctcacccttctcattcactgcacaggtgcccagacacagggtcaggggaggggtccaggaagcccatgaggccctgctttctccttctctctctagaccaagaatcaccgtgtctgtgtctctcctgcttccacggtcctgggcccagtctgtgttgacgcagccgccttcagtgtctgcggccccaggacagaaggtcaccatctcctgctctggaagcagctccgacatggggaattatgcggtatcctggtaccagcagctcccaggaacagcccccaaactcctcatctatgaaaataataagcgaccctcagggattcctgaccgattctctggctccaagtctggcacctcagccaccctgggcatcactggcctctggcctgaggactaggccgattattactgcttagcatgggataccagcctgagagcttgcacagtgctccaggccaatggggaactgagacaagaaccctcttcctcctccgccaggagggtgagtgcctgcagctgctgctcacacctgacctgtagcttctgctgctgtagcttcccccatgggcctcggggcatccagggccttgcctaggagtggaggctccaccacttttgtcctcagagtcaggaacagggaccccaggagacagaatatcctgctcctcagcttgggacacagggtctctgcactgaaatcgtgggctgaggtggcaggtccaactgtgtcttcacagtccttcctgtgcctgcccatggtgtggggacggagtgaggaagtgtgggccattgagcttcactagaggcctgagggagcagaggtgctcccgaagacctggactccttccgtcaccctcctcccatcactctcctcactgtagctgtggccaggtgagggctcagggctacttgaggaccttgctcaacccagggcctccatcccaggcattgtttccaaactctgtaagggctgtctctgaatctgtagaaacatttatttctatgtgcccaggactgggttagagggcaccaaccccaccccttgcaaactgctcatcacctctcagtgaaacaatgaggagaagaaagagttagaaatcagaagcctccccaaggctcccctctctcctctcaaccagcctccccttggcttcctccttccacagaaataaagaggaggcagccacagaaggcaagggaaggtccaggcattataccaggcagtggagccagccagtccccccagatggtggagggaggtggtggaggtgtctgggaccagaaaatagtgaggaccctcttactaaagtgaggaggggtggcataaactgaggctcagatggtggaccagatctcctgagccatctactcatttcttcttgagtttcagtttcagtaagaataggataaaaaaaaagtctgaagaggttcctttcctcagataagaattcgtagaggattattgcccactcaggcattgaggggaggctgagcctccctctcaggccaatagaactgggggctttcatgggaatttgattgtactgaagctcccagactctgacatctaagacttatgctctcgtagcagagcccagcactgataccaaaatggataaaggctgattgataagcctggaatatcctagctgacaccgacttgtggaaaagagaatcaagttagaatattgatgtgataaggtggcatcgcacagtgaggagaggagagcttgtgtgggggagggtagaggagccattagagggttggacaaagaggacacagaatctgaggtaagtttgtgaggaaaactccagatgcttcagagaagatggacaaggaggtaggcagtatgaaggccatgggaccagctctagtcaccgggagtgagtggtgagattcagcaccagtgtctggggaggaggtactgaagcctgggtgaggggagatgctcaaggctggccttaggacctgagtggggcacagtgatcacactgctggggggtccttcaagtgcaagggggctgcaggaaggctcgagctcattgtcacaatgaaaacttagacaacagctccccagacttgttcaaaggtgtcacaggactttttcctctccacatggcaacggggagaggaaaacttatctctgagatatataagatgtttgttctccataacctctcctgtcccctggctgaattcctatttggaaacaaaatgactctccagttttacatatgacatcctcactaaaaaaaaagttccagaatgagaaagatctgccctccctgacccactggtgaggaatctcagccttcaggacaaccagacgaaatcgttcatgccatctcccatgacagcatcatggggaccagggagcatatcttatgggtttgggccacacactgcctgtcccaaacattgcagctggggacacttatatgctgaactcatggctgggagatctggggtctagacatgacaggaagaggaaaaagaccaggagctctgcctaagtagccccagtgtgtgaatcactctaccctccaccctcaacttcagttcgtgatgggtgttgtcttgcgaaaactgacagctgggctgggacacaggcaagagagactctgacccacaaatctccatcgtgggctctctggcctttctgatattctttttgcacatcaattctgggccaagacacatccatgctcatcaagaaggcattgataggagaatcaggtagcctccagagagacaggaagcagataaacaccctcatgttggcctcctaagctcagaggagaaaaaaaagggaaagaagttcaagaagccacactagaagccactgatcaccatcacctcggcacctgtcctccatctgcccctctttcaagtaaggaccagactcaggggacagcacctgcacctccctttctgtccatgcactgtgtagggagcctccttctgctctcatctcaaggcgactgctccgccaggtcagccgtgtcactgctgagagtcttacctcagtcctggtcacagggtcttggatcagcagcaacctggctttgattcagctgtgaccctgccccttcaggacacaaagccgatgattaaagcctaactgaactctcctagatttctcaaaccttagattctccttctctgtgtccctctagaaagtgccacctctaccaaataatttcatgttatttcctcaggtctagagctatttgattaccaaaattctatactcactcttctgctctcattccttgtcatggtccattttccactcaggagctaatgatgccaaccctgtatctacaggccattgtcacaaaaaaaaaaagaaatgagagggttccttagataaatacagggttagcaaagaaaagtttcattaccccttaggaattactccaagatctaagaaaattaattccagagcttcaagagtttactcctcagaaacaacagcatgaatacattaggtagtgaatgttcttggtcttctcaatgaataacctctgaaaggttcagagtatacgtttcaaaaagataagtgcataactttcacaaaaatgtaatcttaacttatgtcatcaattttaattggtatatatatttctggaaaaaaaagcagtatgatggtaaaagaaatgtaaaaaagcctttgtaaaacccagtgcttacagtccaccaggatagcacctgtgaagcaaattttctttgctgaagatacaccgccttttagaataatagcaagatagtttgaatttgtcttcttctctcacaacaatctaaaaattaacatgatcccatttatatgaaatatctagaaatatatctgtacatgtggacattcccatcgcacacctcccatccaggctgtcctaaagtggcatctcctcttcttctgctcatgttctccccctctcctcacctctcctgctgacacgtggctcctccctgccttcctctccagtagccccagcagatcaggcccaaccagtcaacaagctcctggacttggggaacaaaagtacatcttcttggatttctgaggacttgccctgccagggtgtctttctcaatccaatctctccttcccggcagtccacttctcctagatcctgtaatttatctaatcttattcatctgtatctacttcgtggacttccttacatcttcacctgaacaccaggaatcttcaggtcatgcccatatgcccttggttctcctgtagtcccttcttccttcttcccctgtgatgccaccaagtcgaagtctcttctcagaccctggagtgcagcagggacttctctggtctctgccccagggattaagggggtggaagagtggactcctgtgcccttcctatgcctgtgttttcatcagggttagctgcaaaaggtagggattaggctgtctaggtagggattatggcattaggtagggattatggcatttccagagctgagctctatgcccagcaaaagatacgtgctcagcaactacttgacagagacctacctcttatcacatgggacacattatactggacccaggatggggctgaactgggagaggtagctgtggacctgctcctcgctctgccctcaccctaagagctgatggggcatccaccaggaagagcattcctgggcagggagagggccatgagcagccttgtcctgtatgtgagacacagctcagcccggtcacaagatccagatgactatgactgcaattcaggggaagtagagaatgaagattgaccagaataaccctctgggaatgtgccctgggcctcctagagggaagagcttcccttctattcagcgctgcaggatccacagaggaaggagagccctggccaccagggaggagccacatgagaggacccggtgtccccacaaatgggaacgtgagtccatgaaagtcggtccctgctctgggtttgattgtgacctatgaggacattgtgtagtcaccacctgagtcctctacaataaacagtgagagcgccacggacagattcactcccgaggagcccagtaaagtgggaggactgaggtcacagggagaagacacaggcaccacctggcctggccctgacagggggcagtggacagaacagtgcggaggcagtggggtctctagaggctctggtcaccttgtcataccatggtttgtctcggtctggacactagagggcacttggggatcattcctgagaagactgaggttgatcagagcagaaccagccacctgtcctgcctagtgtcctctgctcagggctcacagctgcgtcctttacacccgtgggaccacacagccccacccctgccaccccctgacatcctcaggcatagggacctgacccagggcccagggtgggattagaaagctgggggtctgatttgcatggatggaccctcccactctcagagtatgaagaggggcagggagagatttggggaggctctgcttcagctgtgggcacaagaggcagcactcaggacaatctccagcatggcctggtctcctctcctcctcactctcctcgctcactgcacaggtgactggatacaggtccaggggaggggccctgggaagcctatggattcttgctttctcctgttgtctctagaagccgaataatgatgcctgtgtctctcccacttccagggtcctgggcccagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttccacagtgctccaggcccggggggaactgagacaagaacccacttcctcctctgccaggagggtgagccccggcagctgctgctcaggcctggcctgtggcttctgcggctgctgcttccctcatggtcccaggggcatccagggccctgcctgggagtggaggctcctcctccccttctgtcctcagagtcaggaacagggaatccaggaagcagaatatccctctcccttaacttgggacacaaagtctctacactgaagttctggactcaggtggcagatccagttgtgtcacctcagacccacctctgatagggaacccatgtattcattattctcctttccccaattccaggagtttccggagtggtgtcttcctctccctgctcctcaatgtgagtccctgtgtttcttttctcccaggcctattctttttttttttttttaacaaaactcctttcatgaaggaaaaatgcacacctaataaaccagctgaatttatagcattaaattcggcccattttggcatttttctggatctttgaaaatatcaccaccactgagctatgcaacctctgactaaccccagcagcccttcatgatgctttgtcatctccttcactccccgaatgccctcctgggcagccaggaatctgcctttgccactactgtatggtttccattttctgaaacttactagtgttatcaaacactatcttcccatttgttcgagcttctttcactctgcacacttcttttcagattctccctgctgttgctgaattgcatcccattctacagagggctcattacaacctttgagggtctaggacattctcttctgattctatttatttacttatttattttaaagtttgaattcattgtccatcaaatcaaactctacgggtgatgttcatctaaggtgacaggagtcagtgagggcttctcaggattcttgcttcttcatctcttccctctaattctttctataatgggagaatttcttatctttttaaagtttttctatttattattttatgttggcttttaaggtttttagtgttttttaaaatttttttatttcaataggtttttgggaaacagatgttgttttgttacataaataagtttgttagtggtgatttctgggattttggtgcactcatcacccaagcagggaacactgtacccaatgtgtagtcttttatccctcaccccatcccaccctttctcctgagtccccaaagtccgttgtatcattcttatgcctttgtgtcctcatagcttagctcccatttatgagtgaaaacatatgatgtttgcccttttattcctgagtgaattcacttataatgatagtctccattccatccgggtttctgttaatgccattatttcattcctttttaaggctgagtagcagtctacatatatatatatatatatatatatatatatatatataccacatttgcttcatccactcattgattgatgggcatttgggttggttctatgtttttgcaattgcaaattgtgctgctataaacatgagtgttcaagtaattttttcatgtaatgacttcttttcctcttggtagatacctagtagtgagattgctggatcaaatggtagatccagttctttaatgaatctccacactcttttccatagtggttgtactagtttacattcccaccaacagtgtaaaagggttcccttttcaccacatccatgccagcatcaattattttaatttttttattatgcccattcttgagggagtaaggtggtattgcattgtgactttgattttcatttctctaatcgttagtgatcttgagcattttgccatatgcttgttagccatttgtatatcttcttttgagaattgtctattcatgtctttagcccactttttgatgagattgtttgtttttttcttgctgattagtttgagttctttgtagattctggatattaatactttattagatgtatagattgggaagattttctttcactctgtgggttgtcagttaactctgctgactgtttattttgctgtgcagaggctatttcatttaattcagtcccatctatttatcttcgtttttaatgcatttcattttggattcttggttataaagtctttgcttaagccaatttcttctagaatttctaaggtttcatgtcttagatttaagtctttgaccaatcttgtgttagttttgtataagatgagagatgaagatccattttcattcttctacgtgtgacttgcctattatctcagcaccatttgttgaatagcgtctccttttcccactttatgtttttgtttgctttgtcaaagatcagttaactctaagtattttgcttcatttctgcattctctattctgttacatcggtctatgtgcctatttttataccagtaccatgctgttttggtcattatggctttatagcatagtttgaagtcaggtaatgtgatgcttccagatttgttatttttgtgtagacttgttttggctaccggggctctttcttggtttcatatgaattttagttctatgaagttctgtgaagaatgatggtggtattttgatggaaattgtattaaacttgtagattgttttggcagtatggtcattttcacaatattcattctatacatccatgagcataaaatgtatttccatttgtgtcatctgtgacttctttcagcagtgttttgcagctttcctggtagaggtctttcactttcttggttaggtatatttctaagtattttagttttttggcagctattgtaaaaggggttgagttcttgctttgattctcagcttggttgctgtcgttgtatagcactgctactgatttgtgtcctttaattttgtatcctaaaacttgctgaatactttcactagtgctagaagcatttggggtgagtcttcagggttttctatgtatacaatcatattatcagcaaacagtgacagtttgacttcctccttatcagtttggatatccctgatttctttctcttgtctgattgctctggctaagacttccagtactacgttgaatagaagtggtgaaagtgggcatccttttgttgttccatttctcaggggaaatgcttttaacttttccccattgagtataatgttggctgtgggtttgccatagatggcttttgttgccataaggtatggtcccttctatgctgattttgccaagtttgaatcataaaggatgctggatttcgttagatgccttttctgcatctattaagataatcatgtgattttgtgttttaattctgtttatatggtgtatcacatttatcaacttgtggatgttaaaccatctctgcatttctggtataaaagcaatttgatcatggtagattatctttaagacagctgttggatttgggtagctagtattttgttgaggatttttgcatctagattcatcagaaatattggtctgtagtttatttttgttatgtcctccctggttttggtatcagaatgatactgtcttcacagaatgatttagaaaggattcccattttctctatgctgttgaatagagtcagaaggattggtaccagttcttctttgaatatctaatagaattcagctgtgaatccatctggtcctggattttttgttgtttgcaattttttttattaccatttcaatctagctgcttgttattggtctgttcagagtttctacatcttcctggtttaacctagtagtgttgtatatttccaggagttcatccatctcctttaagatttctagtttatgtacataaaagagttcatagtagcctttaatgatcttttgtatttctgtggtatcaatagtaatatctcccgtttcatttctaattgagcttatgtgggtcttctctcttcttttcttggttaatctcgttaatggtctgccaattttatttatcttttcaaagaaccagctttttgtttcatttatcttttgtatttttttttgttttgacttcatttagttctgctctgatcttcattatttcttttcttttcctgggtttgggtttggattgttgtggtttctccagttctgtgaggggtgaccttagattttctacttgtgctctttcagactttttgatgtaggtatttaatgctataaactgtcctttaagcaccacttttgctgtatcccagagcttttgacaggttgcattaagatttagaacaattgcaatcttactatcaatcaacagctttttaattcctgaggatgtgacctcatttaatcctgacaatagctttattattgcttttcaggcagtagaccgtgattgaagaggtaatgctttgtggcctggaggtaaggttctaaaatttatcaaatattaaattggtgcacaagtaattgcaggttttacaaataaaagtaatggcaaaacccacaaggacttgtgcaccaatgtgatataaacactggaggtcagttaaatttgaattcagtaaaaacaatgataaagaatctgtatgtgtatcacccacacagtattgttcaattgtaatacaaacaactgggtgccctgcattttatcgggaaactccacacagggttcgcagcttgaaagaggcagagctgtggcaggcctgcccttcctgatgccaggtctaggtgcttaacgtcaaagacagagcttctctaagagagctaccctcaagtgaacatgtcagttggcactaaatacatgtgatatgatccccagtcaatgatccccactcacttccctaattctttctattatcctttaagtttgcagactcagggcctccccagaaattgctgcagcctgagttctggacctgggaccgcatgtcctgtcacaaccagatgcaaaagggctctttagtccctacacagaatggcttcagccaggagagcataaataacatgtaagattagaagagctcagaggggctctccttctgtcccatgacagatgaaacttcagggctctgatgcttgtcagggaatctccttcagtgaggccaagatcccaggactttactaaaattagcagagtggaccagacaggcatgtcatggtacaggaattgtgttcagaacaataagtgcagatgcatcttaacaagggccttcacgttctatctttggtgaaaaaggaaatagacaaaggcatggagaaactgaaggactcaatgggtctgggactgaggtagcgctgagtgctttgggcttgtcctggagcagtctgcagatgataacagctgggaagtccacccctgctgtgaccttgtttcatctgcccactggatcagtggctgtgtcctcacaggaaagctggctgtagccagactggccttctccatcccacctgggaaatgtattcagatgactctctggggtgaggttctactaagggcttgggagttatgaggagggggctgatttgcatgaaagaaccatttcaccccctttccttcatctaaaacccattaatagaaacttcagggccattcatagaagtccagctggtctcctacatttgtggggcataaaggatcaatgcctgatgaatgcctgatcaatctaaaggaagaggggctatcagcaggtagtggtcagagtgagaaaggaactgacttttttgagagattcatcaacacagccaccaactctgggacaaatggggtgactctctgtaactgtcaccccaaattacccacaggacactgagccagtcccctcattctattgcttctggttctagtccattcccctattgtccctaaacacgttgcccatgtctgagtccagggtggcagggatacctccatcccagtcaacatctacagagggcctcttctgttcccctctcacctcatgcaggttactactgttgtgggtctggtggagtggcccctggagaacacaaggtatcccttcctctggaaagccaggcatgtaatagacatggtatgggttgatgtagagcagagtggctcatccagatgcaaagcagtaagaccttggctacagaaaattatttcacaaaattccacaccctttcatgacaaaaacactcgatgaactataaatagaaggaaactacctcaacatagtaaagaccatctatgaaactcccatagtttacatcacataaaatctgaacaaccagagacattttctgtaatatcaggaacaaaccaaggatgcatactttcacatcttcaattccaaatattattggaagacctaggcagagcatttagcctagaaaaagaaataaacagaataaaaactagaaataaaagtataaaattatctctgttttcagatgacataatgtcatatgtagaacgccattaaaagacccagaaaataattctgaaagaatgattaagtgaatttggtaatgtttcaggatacaaaatcaccacttaagaacatctcatggctaggcatggtggctgacgcctataatcccaacactagggaggctgaggtgggagaattgcttggggtcaacagttcaagaacagcatgagcaacaaagcaagaacctgtctctaccaaaaataaaaaaataaaaaggaaggaaagtcacttgtatttctatacttaaccaaacaggacaccacccaaaatgaaattaagaaaacaattcaagaggacccacagaccctctgaaggaaggggactgcacccgcaggacccgggagacaccgcaaatactgtgagtgcctcaactgcggaagtgggaaaaggagaccctcctctcccaaacacacacccctactgaagaatgtgaaagtctgttagcaggagaagttctcaactttacctggaacggagttaagttagacagccaagctcagtgaaatacacaggtgtaggaggtagcggggaggccctgggaacttgctgaatccccaagcaacccattcctttctggcaccacaggaatacatcaggaaggaggacagacaagcagcgggtaaaactccacgggaagaaggacttccctagctgaactttgcaacaattcgaatcgggtgagaggcctcctggctctagtatccatggcactagtatccatggctgagaggcccatggatagttcacatcacaggactctgtgcagaaacccccagtaccagcccagagccgggtagacttgctgggtggctagacccagaagagaaacaaaaatcactgcagttcagctcgcaggaagacatccacaggaaaagggggagagtgctacatcaagggaacaccccatggaacaaaaaaaatcttaccagcctttagccctagacctctcctctgacagagcctaccaaaatgagaaataacttggggggaagagtgggagaggggcgaggagtaaaagacaacaaacatggtacagtgtatactgctcaggtgatggctgcaccgggatctcacaaatcacccctaaagaacttactcatgtaaccaaacaccatcttcccaataacttacagaaaaaaaaaaaagaatattataacaatggaatcatatattatgcagcctttcagcattggcttttttcacggagcacaatttccttgagatatatctgagttgcgttgtatcaattatatagtttgtttctttttattgctgagtaatgtttcatggtacggttgtatcaagcttgtttaaccattcgccagttgaggaacatgtggattatttccagtttatttttttggctattaggaataaaactactatgaacattcttatacattaaaaaaaaaagaaaacaattcaaatttcgtcattagaatgagtaaaatgcggctggcacggtatctggtgcccataatcccagcactttgggaggctgagacgggggatcatctgaggtcaggagttgttagagaccagcctggccaatatggtgaaaccctgtctctactaaaaaaagattaaaaaaaattagctgggtgggtggcacactcagtgattgcagctactcatgaggctgaggcacaataatcacttgaacccaggagacagagtttgcagtgagaggagatggtgccactgcactctaacctaggtgacacagtgagactctgtcccaaataaataaataaatgtaaaatacttaagaataaacttaagaaggtaaaacacttgcacattgaaaacaataaaacattgctaaaagaaattgaagaatacacaaataaatggaaagacgtttttgattatgtattggaaaactcaatattgttaagataccagtagaaaccaaaataaaatatactatagagtcatcacaatctttatcaaaattccaatactacttggtacaagaatggatataattctaaaatccagatacccaaaatagccaaaataatcttgtaaaagaagaacgttgttggaatcctgacacttcctgattccaaagcatactaaaaagatacactaatcaaaacagagtggtacatatagacagacatacagacaaatagaatagaattgagtgccttggagaaaactctcagttatatggtcaaatgattttcaacaagcttgccaagaccattcgtgagggaaagaacagtctttttaacaaatgctgttgagaaaactggatatccacatgcaatctggaagtgaatcaaagacacaaatgggagagccacaactgaatcttaaaagaaaacattgggaagtaggtccacaacgtagggtttggaaatgatttcttggatatggcacaaaaaagacagggaaaacatagaaaaagaagaatatagataaattgcatttcatcaaactgtaaaacttatgtgcagcaaaggacactaccaacagagtgaaaatgcagataatagaatgggaaagattgttacaaactttatatctgataaggcatccaagctatagaaagaacttctacaactcaacagtaacaacaaaaataggaataacccgaaaaaaacaaggacaaaggacttgagtagatattactacaaaaaaagatctacgaatgtccaataagtacatgaaaagatgtacagcatcaccaattattagtacactgcaaatcaaatcacaataatatacaactctatacccattaggatggcattaaccaaataacagaaaattaaaagttctagcaaagatgtttagaaattgcaactgttacgatttgctggagagactgcagaatgatgcttccactgtggatgccttatggctgttcctcataaaatcaaacatagaattaccattttatcagaattttcacttctgggaatgtgcctgaaaaaattgaaagcaagatctcaaagagaaaattgtacatcctcgttcatagcagcattgttcacaatagctaaaaggtggaggcagcccaagtgtcaactaatgaatcaacaagatatattatacacacacaagggaatattattcagccttaaaaagaaagtctgacccatgcgatggcatggatgaacctttaagacatcatgccgtcagaaataagctgacttcaaaaggacaaaaattgtttgccagcccttatatgaggtacctagaatagttaactccacagtgacaagaagtaaaacgatgtttcccaggtatgaagtttggtttgggaaaataaaaaatttgtggagatgagtggcagtactgtggttgtacaacagtgttaatttacttaatgtcactgaagtatacatttgaaaattgttgaaataatgtattttgtgtatgaatattttactacagccaaaaagaggaagatttatgtttggtgcagtttctctacctccaagaacagtggaaacctacaggactaggagagtgtgcatgagtatccaggacactcttccttttatgccagccccacagcatccaggacacccttccttttattccagccctgcagcatcctaacaagttaagagagtcagacgtacctcattacaggtgactcagaataatatgagaaagtctagaggtggccatgatgttagcggtgggtgcccaacccagcccaggagcagccgcaaatgcaacagtggccaaagaaggggagatgaagctggtggcagaggtagcagcccctccagctggagaggggcatctgcttctgtacaaaatggttcacagttgataagtcttgcatagatgcctcatcgtttacctcatgaccaactacagttttcattgcaatgtacgttatcatagcagtaatgtctgtttcctcctgtagcaagcaaacatgaacgaaacgtgctttactgctttgtccaacaggacatgttagtcccaaacacaggctgaatgtttaaaggtaacgttctctaaagataaggatattataccatttattgataaatacggggattgcatgatgaccattcagacacttggaataattacttggctaaataacattgtttaaacaatgagtaaatttagttattctttgcagagcaaaaaagatccaagtttcaccagtcccttggcaaacactacatttcaaactatggaagggagacatcctgaaattttgtgctactctttctgaagacacagaaacagtcaagtcatacctaatacttatgagcataaagctttgataaaattcaagaattatttgcattttgaggaaaaagactttgtcgctaaagcagagaagaacctaaaacggactcctcatagtgagctaatattttataaaaaggtgtcaatcaaggtgtggcttacaaaaatactttcaaggatgtttactttccagccatctcactggacaagaactgggtggttttcattaactttggactgtgctttaatttcctaaaaatgatgtcacttactgccctgagtgacatgggatgggatgctgtggtagagcacactctggctgatgtcttgtacctgctggagacagaaaaggatgggagacacagtcctccacaggaaatctcaaatgggtccctctttcttttcagatatggactttctggggagtaatactgtagggcttttcttgttgttgcctttaactgtctcaaatgttctcccaaagatgctactgaacacagcctctcctttgagcaagttaaaagtctgggtacgactgcgagaggctcctgcctgccaacactctttctccactttcagtgactgctcttcttctgagggccgtaaaccaacaactgctcatcccaagatccactaagccctctgggaaattggtgctgtactgcataccctgcctgctgggacttgttacattgatgtattttctaaggagtgaataatcttgtccaagtaactaacttatttaaagacattttcttcggtgggcactgactccatggcacccgttttccaaggagttggtgagcttgtttctgagaatgccagaaatcaatgtacattccaaatcattctaaaagtgatttctttttggtgtgggtttggttttgttattaattttgaaatatatctttgaatactgagatctctgaaactactagatctctagaagtgtaattgggaaagaaggttgcttgcagctttaacaaaatgagaaactcttcccaaatacaacctgttttgaagttaaaaaaaaatgtgacattagaacctgcaaaatctaagagtttccaacagcagtctcaattctgatgctaactgtaagctagggactcccccaacaacgcttcacttcttatgattcccaagaaggactcacatcactcactgaaacttgtgacgtttgttgatatgattttttacaacaaaagaatgcagattaaaataattcaaggaaggaggtacatgggcagagttcaggagaattccaagcacaggcattcagttgtcctctcccagtaaagtaatagacaatgctgcattctcctggcagcaatgtgtgattctgtgcatgaattattgccaaccaggaaagctcgctgaagcttggtgtccaggcaggtttttttgggggtgtgagttggggatggggttgcttatgtagaccttgttgatcatccttatggctgactccgacttgaatttccactgaattgacaataaaacttcaaccttaaatatttggttattttctttttaataaattctctaaaataaattattttgaaaatgctcgctttagctagctgtttatccaatatgagactcaacataaatagtttcaaaaagccagtgggtcattaaaacaattcctttagtcatccaaaacattcagataaaaattaacaccatgtaacactaaaatcgaattatagtcactggggctggatttcaacaacaggaagagaaagtagtacaaatagggatgagcaaaaaatagacaagtaatggatgtgaattggcctaggaaatttacagtggcaatgtcaaaaaggtaaatcaatagttatttgacaatacatgctcagtccaggaaagccaccagggggcggtctgggtcgtctgcatcataagaagctcaaggagttcaaactgaatgaaccctgcacagttgctcactgggtcgtgtaaaatgttagagcagctgcttcctcccgcaacacacggccactctgggcagtcccctcacagtgtggctgctctcagggctgagaacctgggtggtgctaaaggtggtgaatgtggtaaagatttgcataaagcaccacacaacacacctcctccacacagggatctcagtagcatcttcaaaggatgggctttctgagctaagagcaataagaagaaactttctaaacttactaaaatttatttattgagttatgttcaaagcaatacatgcctattacataaaatcagaaagtatttaaaatcaccgagtcctcggcaaaggttctttattccaagcaatcaatatgactatttttttttatttggatgcattctttcatttttgttctcagtatttccacaatggtgatcaagccttgtgctttttcatctgcttttatacccctttatgatctagtcatttcaggttaatgtaagtagtgttccatttcttaaaagggataaaatatttaaatagttgctaattttatttttatttgaataccaatgaaatattatcatttttagataattcttattgtttgctactcaaacgaagatatgatattatcttattattaaaacactcctggtaacttctgtggattttgtgaggtcagaaaaaaaatgcctgaaattttcagtggaaagccttgagtacattacacctgacttcacaatgcagtaaatagagaaacaagagtttccgattcatgtaagaaggagcataacagattaaggtatgaggaataatttatatccaaaactacaccagtgtctccaggcatgtgttagaacagtaccccccaaattctgttgtgcatatgcatcttctggggattttacaaaatgcagattctgattcagtggctctggagtgaggacacagtctctgcatttctagaaagttcctaccacacaaaatccacatatatgtttgaacaataacaaggccagccaggagaagaggctcaggtgtgtaatcctagcactttgggagtttgaggcaaaagaattacttgaggccaggagtttgagaccagccagggtaacgtcacaagatcttttctctacaaaacatgtttttaaataataaaaaatgaattagccaggcgtagtgtggcatgcttgtcatcgtagatacctaggaggctgaggcaggagggtcgcttcaccccaggagttcaaagctgcgatgagctatgattatgccactgcactccagcctgggtgacaaagtgagaccttacctctaataacaaaaacagccataacaaattcataagaatagtgtaaaataaggagaaaccttggcagacaataacctaagagatatctcagacatagtgaactaatgtgtttggatgacagaagaaccccacacttggctggctgtggtgactcaggcctgtaatcccagcactttaggaggccaaggcgggcagatcacctgaggtcgggagttccagaccagcccggccaacatggaaaagccccgtctctactaaaaatgcaaaattagccgggcgtggtggcgcagcctgtaatcccagctactcgggaggttgagccaggagaatcactggaatccgggaggcggagtttgcggtaagctgagatggaacgagccacactccatgcaggaagacgaccagggaggacagctgcaaagcagggagaggctcccctttctttaagaaacaaaacaaaagcaaacaaacaactaacctgacctcccctctggctcccatccaacattcttactagcttctcatctagtcttttctgtagtgtagcccatccttaccctctcccctcccacatctctgattcctgaattcccttcttgggtctctctccttttcctgtcaaccacttctcccctctatcatcctgagttaattatcaagagctttatagcaggaagcctattggtatttttccagattttttttcttggaattggacattcatacattttctctctttttttgggggggtagggtggggtgggggtgggggtagggacagggtctcaccctggttgcccaggctgtggtctcaactcactgcaaccttcacctcctgactcaagcaatcttctcagctcagcatcccaagtagctgtgactatgggcacgcaccaccacaccctgctaatatcttgtatttttggtagacatggggtttccccatgttacccaggctggtcttgaatttctgagctcaagtgatccaccctcctcagcctcccaaagtcctggaattacaggcatgagccgctgtgcccagcctattttttctcttttacgagcctctctgattccctagttctgaagtagcccagagttggctgattctcctattttgcctcagctagcacttcctccttctcctttttttttttctccttctgatccctggagtcctctgcatttccactgaatccagtgaaccacacaagcatgctcatttattctccccaaactccaccactctgccttatgtgctgatccagtgagaatcaagaaggaagagagacccatggatttctgtgcagcctggaaagtcagttcatggctggacttggctgggacaccagacacctgtctccctgtctctatttagtattcatagggcccagcagctgcatcctcccagggtgcctgaagagtcactgaccatgctctcctacccagcctcaagaagccacccagtcctcgagaagtataatcagactcagcatcttatgtgaagggaacaaccatggggacaggttagacttgcattgagtcccctcctctaagaagggccagggaaaaggggctgttccccctaatctgtgtggctcaggaagtagagctccagagacttctctaccatggcctgaatccctctgctgctcaccctcctcagtctctgcacaggaggctggagatagaaaggcagggactggcactgggaggaccagggctctgccttgctcccccggctcaccgagccacttcccacaccctgtgtctctgtcctgactcttagggtcctgggcagtcagggctcacttggtggcctgcacagtttgtctgtgactaaaccagccaccatctcctgcactggaaacagcagcaataacgtccttggaattgtgtcctggtaccaacaatgaacaggaagtgtccttaaacctctgatctgtggatgtaaatatccacctgcagatccagaactgattcttgagtgatcagtctggcaaggaggccttcctgagcatatctgggctccaggctgaggacaaggctgatcattaacgttggatttggacagttctctggaggcccccacggtgctgcagtctgtggggaagtgagatgggaacatttcaggtctcctaggagcacgacccgacagcaccacctacaactgggaaaactgggctgtttaccatttgtgttcatgtttgcttgggctggtgctagccagggcccaggtctcaggtcagggacagtgatttagagaatgcagctttgtttcctcagagtcagccctcagagaaagcccatagcaacagcattgtcaaattgcctcaaaaaaaatcagaaagtccttggttcctggaacaggctgccctaggaacagagcccaaatcggtcagagcaagcagggacacaactgtgcagaaaacaacaagttttacttagggagataacggttgactgtataaaatgagaaatatgtcacactactcacttgtaaaagtaagtttaccaatgctattcatttccctatatcactacgttgagtaaaaactctaaaatgtatgaaaccactgtagagataacttttgctgaattgctactttaacatgtcatggatcatttatttttcttgcaaaattctcattattcaccgtccttttgagtaacccccagctgcccttcaacctagctcctcagctgacctcttctccatgatgcctaccctgatggcacatgtgggcagttaggtttttctagattttaaaagttatatatgtacatgtctacatcccatggaccaagactcactctgggagtgagaaatcacaataatcatgcatagccttatggaattagtgtctagcaatcagaccatagaggtgtgaatagagacagtgactaatgagctgcagagatcagctgggccatcaggaggtaagtgtcctctaaccagcatgggatgctgggggactgccctatggtccctacacagctgctcagtaaggaccattcactcaaagaaatccaagactaggggctaagaccccgtgctcactgaggggtacttagcatctatgtcctcccatggcatggcagagtcccctgagcaggaaggtgtgtatggtttcagtaggtgctttcttccggagccctctcaaggggaaaagcaaaacttcttcctcctcagtctgcagtgtgagctgagcttcagccccagagcttagagaggggctgggcagtccctggatgaaaacacatttgcatgagcagcccctcctctgcagagtatgggaagaaaaggaggcctggggcagcccagtcccactgtgcatgtcaggctgtgtccaccatggcctggactcctcttcttctcttgctcctctctcactgcacaggtagggacaggcctcagagatcagggccagccacccaacctgattctggctcttctggtaaagatccctgaaaaacctcaccctgaaccctgcccatcaaccatgagtgtctgtgtttgcaggttccctctcccagcctgtgctgactcagccaccttcctcctccgcatctcctggagaatccgccagactcacctgcaccttgcccagtgacatcaatgttggtagctacaacatatactggtaccagcagaagccagggagccctcccaggtatctcctgtactactactcagactcagataagggccagggctctggagtccccagccgcttctctggatccaaagatgcttcagccaatacagggattttactcatctccgggctccagtctgaggatgaggctgactattactgtatgatttggccaagcaatgcttctcacagtgacacacacagatggggaagtgggacaaaaacctcaccctgctttaggtcttgttcttaaaaaattttaaattttaaaataactggcctaggcacaaactacatttggaagtactttctagttgtaaaaggctcttctctcaatttcccatccattcgtctgaagtctcagtaaaacaaaacaaaaccaaagcaactgatgacactgaagtcttggctggttgtcatatgtgctaacaccactgcctgtggagctggacttttgttcttgaaagaagcaaaatgaggctttcctagctcacatcatggtcagagcctggggacatcctagcaggtgaacagtgccctgcagcatggactctgctcttccagcgtacgggcagagacctccccttccatccccagtagtctgttctcagggctgtctgtggctcactgtgtcccaggaacaaggcactcaaatatgaaatgctgcctgaggacacaggtcagggaattctagatatagtgctgacctggctcagtcctgggtacctgcatttcagtggcaatgtcaggagatggggttaggtattagggtaactggggacctgagaccagtaaacctctatgtaggacatgacaggagagtcaaggggaggctccactgtggctgagacaagccagaggctgctccttggccacgggggaagtaggtcccatggatgtgactttcctgcagctcatcccactcaggaccatggggactgctgagcgtgggtttcttgatccctcagcgcctgtgttctcttctcctctcttacaccattggagcttcttgctgaatcagggtctagtggtgagtatgtggaaagaccaccacatctcaaggtcacctttttctgcatggggagcagcagaaacattgggcattcccgtggaaatggctacggaggcctcccagaaagagcccccaagtttatgacctaggacagcagtgatggtccctcaggggtcccagcctcattctcctgctctgggtttatccacacagcctcctggagcacctctcggctccagcctgaggactggctggttatcagtgtcacacagctgcatcctgactccatgttaccaagggttcctgttccatgtggaaatgagagaaagatctccccactcatcctgtctccccatccctcctttatccctgcctgtgaccaacaccagttcatgccaagacttcggctgtcacttgtgttactgaagcagagcacaagttcagtaaaaataatcccttttcttactggtctcccaatgcaaacagaatcaatttgtttctagaagcaaaaggagctgcccacacatggtgggtggggatgaggtagggacaagaaagaatccaccctgtgtgacccagaggcccagaagcctttagtctggttccaaaggtgtctcctcctcttggtgcagttatgctgaccatttcctgagctcagaaactgtgcgagagatgccaagaatgaagaatccagcctgtgtgacccagagacccaaacgtgagacaggaagtctgatgcttaagaaaacgtgggttcagcattctgaaaggtctagatatggcttggcctagagctggtgtagaagagaagcaagagagatgctcagccttaggtggcccaggcacagcggtcctgtcaaggggttgagctctctgcaacatggaaatcctgcagagacatacttgggaggctgtgatcccagaatgacacaaaaatgctaatggaaatgagcaggggattgtttatgggggaatggggagacaggtgtgggataagatgtggtaaggagaatgcagcctgaagaggagactgtccattgtgactcataggaggagtagggccggggcctacagtagtgataaaaggaggacctggaaggacctgggccctgaagacacacagagactggagttttggtctgtctgtgagggtcccatgaggataaaaatccatggtcagtgtcctctgtccagggctcactgtcccagctgttgtccctcctggatcctctgggtgtccagattccgtagctgtggacctgttctcctctctgtcctcagcctaagagctgatggggcatccaccaggaagcacatctgtgggcagggagggggccatgggcagccttgtcctgtatgtgaggcactgctcagcctcggtgatccctgttcattaacgtgggaggaaaggaaaacaaaattcactgtgaacatctatgcatcatcaaagaaaaagcaatgagccaaacaggaagtgaagcccagctctaatagtttgtttctacttggaaataaataaaacttaatatgcctgatgtgttacgtaaatgcaataaacattttttgaaagctataaaaattatgtaaaggaacatggcttacactaaaaggaacacttaaaataatgacacccttgaaatgcaatcccaaaacacagcatacattttatttcagttccatatatggactggttttatttaaatgtctatattaaatctcactattccatttttaaatggagcacttaaaatctcattctacggcaactgcctggtgatacatttaccagtggaaatatcaacaaaaccatccagctgttttcctccatccccatagaattccccaaactagtaattattaagagcccaggatgtatcatgccagaattcatgcagtcataggcataacctgtttcatttttcattctgatcaacagaattacaatttttcttaagcttgtttttagcttattagattctagttgtcattacagatcaaagataaataattttctatcatccttaagccacccccataacactcactactgaatttgaaccataatttttccctaaaaatcctagttggggtgcttgatgttgagagctaccacgtatcaggctcacctgaggacagactctggttaaaccaagttaaaattttaattcttcccatcttcaaagactgagcatctttgctctttttgttcataagtgaaacactccaaagtcatttgccaggatcccctgcagatgagcatttagtgtacagactcctaggcaagatccctggtcacagtatccagatgactatgactgcaaatctggggaagtagagggagaacaaagatttaccaggaaaaccctctgggaattcctccccagggaatcctagaggaaagagctccctttctcctcagcgccacaggatccacagaggaaggagagctctagccaccaggaaggagccacatgagaggagaggacctggtgtccaacacaggtggggaggtgagtccatggggctggtccctgctatgggcttgatcctgacataggactttatgtagataccacctgagtcctctacaatgtacagccaaagagccatggaaagattcactcctgaggagtctgaagactcctcagtagagcgtgaagatagccctgaagtcacagggaggagacacagacaccacttggcctgccttggacctgagagagggggcagtggacagaatggggggaggaagccatgtatctgagaggttctggtcaccttatcatagaatggtttaccttgatctggacaccagagggcgcatggggatcattcctgagaagacaggggtgatcagagcagaaccagccgcctgccctgcctggtgtcctctgctcagggctcacagctgtgtcctccccaccccctgggaccacaaagctccacccctgccaccccctgacatcctcaagccaaggagcctgacccagggctcagggtggggtcacaaacctggggggggtctgatttgcatggatggactctccccctctcagagtatgaagaaagggagagatttgggggaagctcagcttcagctgcgggtagagaagacaggactcaggacaatctccagcatggcctggtcccctctcttcctcaccctcatcactcactgtgcaggtgacaggatggggaccaagagagaggctctgggaagcccatgcgaccctgctttctcctcttgtctccttttgtctcttgtcaatcaccatgtctgtgtctctctcacttccagggtcctgggcccagtctgtgctgactcagccaccctcggtgtctgaagcccccaggcagagggtcaccatctcctgttctggaagcagctccaacatcggaaataatgctgtaaactggtaccagcagctcccaggaaaggctcccaaactcctcatctattatgatgatctgctgccctcaggggtctctgaccgattctctggctccaagtctggcacctcagcctccctggccatcagtgggctccagtctgaggatgaggctgattattactgtgcagcatgggatgacagcctgaatggtcccacagtgctccaggcccagggggaacagagacaagaacccccttccttttctgccaggagggtgagccccggctgctgctgctcaggcctggcctgtggcttctgctgctgcagcttcccccatgggtccagggatatccagggccctgcctgagagtggaggctcctcctcccctgagtcctcagagtcaggaacagggtgtccagaaaacaaaagcagggtgtcctgctccctgtagcttgggacacagggtctctgcactgaagtcctgggctgaggtggcaggtccagctgtgtcatcacagacccacttctgttggggaacctgtgtctccatcatcctactttttccatttccaggagtttccagagtggtgtcttcctcccccttctcctcagtgtgaatccctgtgcttcctttctctccagcctattctttttttaataaaactcctttcatgtaggaataatgcacatataataagccacccatatttacaatagggaatgagacaaattttggcatttctatggatccttgaaaacatcaccaccaccgggagctatacaacatacaacctgtgaccaaccccaatagctcctcatgacccttgtcacctcattccctcccccaacaccctccttggaagttgcagatctgcctctgtcactactgtttggtttctcttttctggaatgtatcagtgttatcaaacattatcttcccatttgttcaggcttctttcactctgcacacttcttttgagattctcgctgttgttgctgcattgtacccatctcgtagagggctccttactatctttgaaggtccttaggccatttttttctgattttatttatgtatttattttaaagtttgaatttattgtgcatccaaatcaaactttaggggcaatgttcatctaaggtgacaggacagtctgtgatggcttgtcgggattcttgcttcttcatctcttgcttctgattctctctatagtggaagaggttctcgtctttcatttatttatatatttatttatttactgatttatttgggtttttaagggttttagtgatttttctctttttggttatttttcaatttttttattttaataggtttttgggggacaagtgttgctttgtcacataaataagttctttagtggtgatttctgagattttggtgcactcatcacccaagcagtgtacactgtacccaatgagtagtcttttattcttcacccccctcctaccctttctcctgagtccccaaagtccattgtatcattgttatgcctttgtgttctcatagcttatctcccactgatgagtgagaacatacaatgttttgttttccattcctgagttactgcacttagaataacagcatccagttccatccaggtcgctgtgaatgccattattttgttccttttatggctgggtaatattccatggtatgtgtatgtatacatcacatttgctttatccacctgttgatttatgggcagttgggctggttccatgcttttacaattgtgctgctataaacatgcgtgtgcaagtatcttttttgtataacgacttctttttctctgggtagatacctagtcgtgagattgctggatcaaagggtacatctatttttatttccttgaggaatctccacactgttttctgtagtgactgtactagtttaccttcccaccaccagtgtaaaagtgttttgttttcaccacatccatgccaacatctattattatttttattttttgattatggccatttttgtggtagtaaggtggtatcacatcgtggttttgacttgcatttccctgatcattagcgatgtcaaacatttttctatatgtcttttgtccatttgtatatcttcttttgaaaattgtttattcatgtctttagtccatcttttgatgggactgcttattttttttcataatttgtttgagttctttgtagactatagacattagtcatttgttggatgtatagattgtgaagatttgcttccactcggtgtgctgtctgttagctctgctgattcttttgctgtgcagaaggtttttagtttaattaagtcccatctatttatctttgttcttgttgcatttgcttttgggttcttggtcatgaagtatttgtctaaagtaatgtctagaagggtttttttaatgttatcttctagaatttttacagtttcaggccttaaatttaagtctttgattcatcttggcttgatttttgcataaggtgagagatgaagatccggttttattcctctacatttggcttgccaattatcccagcaccatttgttcaataggatgtcctttttccactttatgtttttgtttgctttgttaaagatcagttatttggctccatttctggattctctattctgttcctttggtctacgtgcccacttttgcaccagtaccttgcagttttagtgactgtgagtcaaattatgctagagtatagtttgaagttgggtgatgtgatgcctccagatttgttccttttgcttagtcttgctttggctatgcaggtcttttttggtttcatatgaattttaggattgttttttccagttctgtaatgaatgatggtgatattttgatgggaactgcattgaatttgtggattgcttttggcaccatgatcattttcaacatattgattctacccattcatgagcgggggatgtgtgacatgattttttcagcagtgttttgtagttttccttgtagaggtctttcacctccttggttgggtatattcctaggtgtatttttttgcagctatttgtaaaaaggtttgagttgttgatttgattctcagcttgttcactgttattgtataacagagctactgatttgtgtgccttacttctgtatcctgaaactttgctgtatttatttaccagttcttttttttttttttttttttttttgagatggagtctcgctctgtcgcccaggctagagtgcagtggcgcaatctcagctcactgcaagctccgcctcctgggttcacaccattctcccaccttagcctcccgagtagctgggactacaggtgcctgccaccatgtccggctaattttttgtatttttagtagagacggggtttcaccgtgttagccaggatggtctcgatctcctgactttgtgatccgcctgcctcggcctcccaaagtgctgggattacaggcgtgagccaccgtgtctggccatttatttaccagttctaggagatttttggatgagtctttaaggttttctaggtatatgatcacattatctgccaacagcaacagtttcacttcctctttaccaatttggatgtcctggatttgtttctcttgtctgattgctctggcttagacttccagtactatgttgaatagaagtggtgaaagtgggcattcttgtcttgttccagttctcaggggaattgtttccaacttttttttcctttcagtataatgttgactatgggtttgaaagagtgggcttttcttaccataaggtatgtctcttctatgtcaattttgcaaaggcttttaaccatgaagtgatgctggattttgccaagtgctttttctgcatgcattgagataatcatgtgatttttgtttttaatgctttttatgtggtatatcacatttattgacttgcatatgttaaaccatccctgcatccctggtatgaaacccacttgaacatggtggactatgtttttgatagctgttggatttggttagctagtatttcgtttattatttttgcatctatgttcatcagggatattgttctgtagttttcttgttttgttatgtccttccctcattttggtatgagggtgacactggctacaaagaataatttaggaagaatttcctctttctccttcctgtgaattagtgcattagtcagggttttctagatggacagaactaatggaatctgtatatatatagcatgatcacaacatcccacaataggctgtctgcaggctaaggagcaaggagagccagtccgagttccaaaactgaagaacttggagttccatgtttgagggcaggaagcatcaagcataggagaaagttgtaggctgggagcctaggcccatctctcttttcatatttttctgcctgcttattttctagccatgctgttagctgattagattgttcccacccagattaagggtgggcatggctttcccacccactgactcaaatgctaatctcctttggcagcaccctaacagacacacccaggatcaatcctttttatccttcaatccaatcaagttgacactcagtattactcatcacaagtccaccccttgtcaacttcaacccatatatatcttctgagatcatacataatcttcaaataaagacaataataaggtcataatgacacctaacataatacaactatcattcatacaaacagaaacacatcaatccccaacccaaatactgttacataaagttaacgatacttaaacgctgatgtgaagtcaataaatcttatgtcacatgataaaggagaaaggaaataacatgaagatattttcttaggacaaaggtatacacgcacaaacatgtttttaacaaaagaaggaggaaatactcatgacaattacactcctcgtttctgcagctggccatagctggtattgatgattactttcttctactatccattctgtattctgtattccctttgccttcagcaagcacctcagcaggtcgtggatatttttccagatggtgtgatccaaatcttcattcctgaagcatctggttcatttgtagtcctgcctggatagggctgttttagttttccatggaccttaatcacagggcatgataatactaagaaatgccctaatggatctcctgtattccatgcatactcttccttacctccgttatggagtagtaaactgatttcatcttgatagtctgtcccaaacaccccagccaacactgtaactcccttcttagcctgttgacttaaaggtaggaggagcccaaagtgtccaggtggcaatcttaacttccccagtttaatggaatcattgatgtgtctccaagtggcagtgttccttcctctggaactaaatcctctaagccagcagaacataatgtcgtgggaacaggaagcaaaaattttgctagtggatcactaggggtgatggtgagtgctgccacttccacttccaccccttgattcctagactcatgaatcctggctatgggagaaacagtgccatatattggatgctgactcagagcatacacgccttctggggaacttagccccagcactgcaaagtattgtcacctagttgacattgtaattgtgacttcaaaaggccattccattgttctatcaatccagctgcttcaggatgatgggaaacatggtaagaccagtgaattttatgagcatgagcccactgctgcacttctttatgaataaagtgagtgccctggcgagaacaatgctatgtggaataccaggatggtgaataaggcattccatgagtccacggaggatggtagtcttacaggcaaacccatatctggaataagtgtctatatcagtgaggacaaacctatgcccttctcataatggaagatttccaatataatcaaccttctaccagatagctggctgatcaccccaaggaatggtgccatatcaagggctcagtgttggtctttgctgctggcaaattgggcactcagcattagccatagctaggtcacccttggtgagtggagagccagttcgagttccaaaactgaagaacttggagtatgatgttcaagggcaggaagcatccagcacaggataaagatataggttgggagggtaggccagtctctcttttcacatttttctgtctgcttatactttagccatgctggcagctgattcgattgtgcccacacagattaagggtgggtctgcctttcccagcccacttactcaaatgttaatctctttcagcaacaccctgaaagacacacccaggatcaatactttgtatcctttaatccaatcaagttgacactcggtattaaccatcacaattaatgtcataggattagtactaattcttctttgaatgtctgatagaattcaactgtgaatctgtctggtcctggctttattttgttgattttttttaaattaccatttcaatcttgctgcttgttactggcctgttcagagtttctatatcttcttcatttaatttgggagggttgtatacattcagaaattgatccatctcctctgggttttctagtttatgtgcatagaggtaatcagagtagccttgaataatcttttatatttctgtggtatcagtattaatatcttctgtttcatttctatttgagcttatgtggatcttctcccttttcttggttaatcttgctaatggtctattaattttatttatcttttcaaagaaccagttttttgtttcatttgttttttgcattgctttttgtttcaattttatttagttctggtctaatcttcgttatttcttttcttctgctgggtttgggtttgccttgttcttgagtctccatttccatgaggtgtaaccttagattgtctatttgtgctctttcagactttgtgatgtacgtatttaatgctaaacattcctcatagcactgcttttgctgtatcccagaagttttgataggttgtattaagatttactacaactgcaaccttactattgaccaatagctttttaattcctgagagtgtgacctcatttatgcccaaaaacaactttatgattgcttttcatgcagtaggccatgattagagagggagtgcttgtggcctggaggtagggttctccaatttatcaaataaaaacattggagtgcagttaaatttgaattcggtaaaacaatgacaaagaattagtatgtgtatctcccacatgatattgttaaattgaaatacaaatttacctgggtgcgctgtagtttatctaccaactcctcacaggcttcgaggcttggaagaggcagtgttggggctggtctcctcttactgatgccaggtctatgagctgaacctcaaaggcagagtctctctaacacagctaccctccagtgagcatgttagttagcactaaatacaccatatacgatttccaatgaataacacctactcacttccctaattcttctttctattattctccaagtctgcagactcaggacctccccaggggttgctgcagccagagctctggatgagggacctcataagtctttcaaaaccagatgcaaggggactactcggtccccacacagtgaggtttaagccaggggtgcataagcaacatgtaagagacagaagagctcagtatggctcttatggctctccttctgtccagtgagaaaactccagggtccttttgatgctgaaggtgggtgggctgagagtaggaggagacccaccctgacagcccagagattccaggacaagacttggcagcctgaaaaggggccacactcttgagtggggaagaaggaggcaactctgctcacaggcgtgcatttctggtggcttcccctttaccaaactggactccctactctgatgtctatcagagaatctccctcagtgagaccaagatcccaggacattgctaaaaacagcagcatggaccagacaggtatgtcatggtacaggaattctttgcagagcaataaatacaactgcagcttaagaggggccctcatagtcataactttggtgaagaagaaaatagacaaaggcagggagaaactgaagggctcaataggtctgagactggggcagcactgggtgctataggcttgtccttgaggggctgcagataatgacagctgggaagccatcatctgttcactgctcactgggctcagcagctgtgtcctcacagggaaccagattcagccaacctggctttctccaccccacctgggaaatgtattccggtgactgtctggactgaggttctatgaaggggctaggagacaagaagagggagacaggctggtttgcataaagaaagcattgcacaccctttcctttcatctaaaactcattaatggaaactctggggccatccatagaagtctagctggtctcctaaatttgggagttatgaaggattcattcctgatcaatctacaggaagggccatcagcaggaggtggtcagagtgagggagaaactggcttccttgagagactcttcaacacaaccaccaactctggggcaaatggggtgacttgctataacagtcatcccaaactactcacaggaacctgagcctagtcccctcaccttattgcttctgattctggtccatgcctctgttttccctggaccccttgcccatgtctgagtccagagtggcagggatggttccatcccagtcaacatctacaaagaagtctacatctacagctactatgacttgaagcagagtccacagttgtacccaagagggcctcttcagctcccccaccccttcacacaggtgacctctactgtaggtctggttgagtggcccctggaccctggtgaacacaaggtatttattcctctctaacaccaggtatatagtggagcaggtctgggtgggtatagagcagagtgtctcttccaaatgtaatgcagtaagaccctggctacagaaaatcatttcacaaaactccacgccctttcatggtaaaaacacccaatgaactatgaatagaatgaaactacctcaacacagtaaagaccatctatgaaaatcccacagctagtgttggccgggctggtctccagctcctaacctcgagtgatccgccagcctcggcctcccgaggtgccgggattgcagacggagtctcgttcactcagtgctcaatgttgcccaggctggagtgcagtggcgtgatctcgtctagctacaacctccacctcccagccgcctgccttggcctcccaaagtgccgagagtacagcctctgcccggccgccaccccgtctgggaagtgaggagcgtctctgcctggccgcccatcgtctgggatgtgaggagcccctctgcccggctgcccagtctgggaagttaggagcgcctcttcccggccgccatcccatctaagaagtgaggagtgtctctgcccggcagcccatcgtctgagatgtgcagagcgcctctgccccaccgccccgtctgagatgtgaggagcgcctctgcccggccgcgaccccgtctgggaggtgaggagcgtctctgcccggccaccccgtctgagaagtgaggagcccctccgcccggcagccaccccttctgggaagtgaggagcatctccgcccagcagccgccccgtccgggagggaggtggggggccagcccccgcccagccagccgccccgtccgggagggaggtggggggtcagccccctgcccggccagccaccccgtccgggagggaggtgggggggcgcctctgcctggccgccccttctgggaagtgaggagcccctctgcctggccaccaccccgtctgggaggtgtacccaacagctcattgagaacgggccatgatgacaatggcggttttgtggaatagaaaagggggaaaggtggagaaaagatagagaaatcagattgttgctgtgtctgtgtagaaagtagacatgggagacttcattttgttgtgtactaagaaaaattcttctgccttgggatgctgttgatctatgaccttacccccaaccctgtgctctctgaaacatgtgctgtgtccactcagggttaaatggattaagggcagtgcaagatgtgctttgttaaacagatgcttgaaggcagcatgctcgttaagagtcatcaccactccctaatctcaagtacccagggacacaaacactgcggaaggccacagggtcctcggcctaggaaagccagagacctttgttcacttgtttatctgctgaccttccctccactattgtcctatgaccctgccaaatccccctctgcgagaaacacccaagaatgatcaataaaaaataaataaataaataaataaataacaaaaaaaaaaaaaaagaaaatcccacagctaacatcatatgcaatctgaaagaccaaagaggtttttgtaatatcaggaacaaagcaataatgcacactttcaccagttctattaaaagcagtattggaagacctggcaagagtaattaggcaagaaaaagaaataaacagaataaaaattagaaataaaaaataaaatctctgttttcagatgacataatgtcatatgtaaaatgcccttaaaagtcccacaaaaaattattagaatgattaaatgtattcagtaatgttttataatacataatcaccttgtaaaaacatctcatggctaggcatggtgactcatgcctgtaatcccagcactttgagaggttgaggtgggaggatttcttgggttcaagagttcaagaacagcctgggaaagaaagcaaggctctgtctctaagaaagcggtggggggtggggggaagagagaaagagagagaaagagagagaaaagaaagaaagaaaaagaaagagagagaaagaaagaaagaaaggaaagaaaaagaaagaaagaaagaaaatctgttataattctatacttaaataagcaaacaggaaacaactcaaaatgaaattaagaaaagaaatcaaattacaacatcattcgaaagagtaaaatacggctgggcacggtggctcatgcctgtaatcccagcattttgggaggttgatttgggggtatcacctgagattagaagttcaagagtagcctggtcaatatggtgaaaccctgtctctactaaaataaataaataaataaataaataaataaataaataaataaataaataaaatttaaaattagctaggtgtggtggcacatgtctgtaatcccacctgctcggggttgaggcacaagaatcactcgagtatggtaggcagaggttgcaatgagccaagatcctgccactgtactccagcctgggtaacagagtgagacaatgtctcaaataaacaaataaataaagataaacgagtaaaatacttaagaataatattaatcaaaatggtgaaagacttgtacattgaaaactataaaacattgcaaaaagaaattaatacacaaataaatggaaagaaatcctttgttcatttattggaaaactcaatattgttaagctaggcatacaaaccaaaaggaatctacagattcattgcattctctatcaaaattccaagttagtatggagatcattaaaaagtcaggaaacaaaagatgctagagaagatgtggagaaataggaatgcttttacactgttggtgggagtgtaaattagttcaaccattgtggaagacggtgtgatgattcctcaaggatctagaaccagatataccatttgacccagcaatcccattactgggtatatacccaaaggattataaatcattctactataaagacacatgcacatgtatgtttgttgcagcactagtcacaatagaaaagacttggaaccaacccaaatgcccatcaaggatagactggataaagaaaatggggcacatgtacaccacggaatactatgcagccataaaaagggatgggttcatgtcctttgcagggacatggctgaagctggaaaccatcattctcagcaaactaacacaggaacagaaaaccaaacactgcatgttctcacttataagtgggagttgaacaatgagaacacatggacacagggagggtaacatcacacaccggggcctcttggggatgggagctaggggagggatagcgttaggagaaatacctaatgtagatgatgggttgacaggtacagcaaatcaccatggcacgtgtatacctaggtaacaaacctgcacggtctgcacatatatcccagaacttaaagtatatattttttaaaaagtgcaagccaaacaaacaaacaaaaagaatagaaaaaaattaatcctaaaatttatatataatattgagagaatctaaatagtcaaaatcatcttgtaaaagaagaacagtgttggagatttcacaccgatttcaaaacatactacaaagctacactaatcaaagcagagtggtacatatagacagacatactgacaaataaaacagaactgagtgcctaaaaaaacctcttagttatacagtcaaataattttaaacaaagttgtcaagaccatttagtggaaaaggacagtctttttcacaaatactgttgagaaaactggatattcaccagcaatctggaaatggatgaaagacccaaatggaagagccaaaactgtcaaaatcttaaaagaaaacattagggagaaggttcataatatagggtttggaaatgacttcgttaatatgacaccaaaggcacagaaaaaaatagaaaaagaagaatatagataaattggattttatcaaattgtaaaacttatgggcatcaaaggacactatcaaccgagcaaacatttgaatcatagaataggaaagattgtcgcaaattttgcatctgataagagatgcagactatagaaagaactcctaccactcaagagtaactacaaaaatgaaaacaatctgaattatatgggcaaaaaacttgagttcgtattgagtagactccaaagaagatctacaaatgggcaataagcacatggaaagatgttcagcatcactaatcattaggccagtgaaaatcaaaccacaataatatacaactccacacccattaggatggcattaccaaaataatagaaaataacaagatctagcaaagacgtatagaaattataactgttatgcattgctggagggactataaaatgatgcacccattgtggaggtcttatggcatttccccaaaaaaattaaacgtagaattgccattttatcggaattttcagttctgggtatgtgcctcaaataattgaaagcaggatctcaaagagaaaattgtacacccttgttcatagcagcgtcgttcacaatagctaaaaggtggaggcagctcaagtgtcatctaatggataaacgggatacagtatacacacacaagggaatagtattcaaccttaaaaagaaagttctgctattctgaataatgccgcaataaacatacgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtctcagtaaactattgcaagaacaaaaaaccaaatgccgcatattctcactcataggtgggaactgaacaatgagaacacatggacacaggaaggggaacatcacactctggggactgttgtggggtgggggtaggggatagggatagcattgggagatatacctaatgctagatgacgagttagtgggtgcagcgcaccagcatggcacatgtatacatatgtaactaacctgaacattgtgcacatgtaccttaaaacttaaagtataataataataaattaaaaaaaaaaaagttctgactcatgcgatggcattgatgaaccttaaagacatcacgccagcagaaataagctggcttcaaaaggacaaatattgtttgcttgcccttatatgaggtatctagagtagtcaaatccatacagacaagaagtagaatgaagttttccaggtgttaagttttggtttgggaagatgaaaaatttctggagataaatggtggtactgtggttgtacaacagtgttaatttacttaatgacactgaagtatacacttgaaaatggttaaaataatgaattttgcatttgaataatttaccactgtacaaaagaggaagatttatattcagtgtagtttctctaccaagaacaatcaaaacatacaggattgggagagtgtgcctgagtattaggacacccttccttttatgccagcctgcagcttcctaagaggccaatagagttggaagcgcctcattactggtgactcaaagtaatgtgagaaagtctgggagtgaccatgatgtaagtggtgggtgtctgacccagcccaggagcagccgcaaatgcagcagctgccaaaaagggggagatgaaactgatggcagcagtaacagcctctccagctggagtggggcatctgctcttgtgcaaaatggttcacagttgatacatttagcacagaatctcatcctgtctacctgtcatgatcaactacaatttttattgcaaagtatgccatcagagtggcatattttatccagcagcaagcaaacatgaaggaagtttcccttagtgctttggtcaaactggcatggcagtcctgaacactgaatgaatatccaaagacaaggttctccaaagataaagatattatactatttattgataaatactgggagtgcatgatgaccattcagacacctgggaaaatgacttggctgaataacattgttaaaacaatgagtaaaaaaagagatgtgctcttggtaaaggaacacctggatccagggtataaagaccggaaagaagactaccgcagatttggacttttggatcaggacttggtaacattgaccctgtttacgacaaccaaaaacaaagcagtgctgtgtctacagtgggaatctgagtcaggaaactgcagcaggaacagcagaaaaaaggaagaggagctcagtgcaaacagaaggatggggagaccacagggaccaccaagaaggcccagagtgactttttgttttccgctcagggctgtcctcctcacaccccttggatcacacatttaatgaagacggctactggtatagtctaacttagcctgatcctcacacggttggtcctcagaagcttgaaattaactgctgggcaggaaaacctattcctggagacctctacagtgactgcttctatgaacaggttttgttagatcaacatgattaagctccccagttagagatctccagtgactggctggctgactgtggttggaaagaaggtctactttatggtgcagacctctcatgggatacggaaagggtcctggtactttgaaatcaccatgaatgagatgccaccagacaccactgccagactgggttgatctcagccctaaggtaactatgaagctcccttaggttatgataaatttagttattattggcagagcaaaagggaatcaatttccaccagtccactggcgaacactactgttttagctatgggcagggagacatcctacgattttatattaatcttcctgaaaacccaagagacagccaagttaccaagataaggctttgataaagttcaacaattatttttattttgtggaaaaagactttgtggctaaagcagggaagagtctaaaacagattccatatagtaaaataatattttataaacatggtgtcaatcaagatgtggcttcaaaagatatttttagggggttacttttagccatctcactggacaagagcttcatagtttccattaactttggactgtgctccaagtatcctccaaagaatctcacttactgccctgtgagtgacatgggctgggatgctgtggtagagcacactctggctgatgtcttgtattttctggagacaaaagaggatgggggcacagtcctccatgggaaccctgaacaggtccttctttcttttcagatatggactttctggggaataatattgggtggcttttgttgttgttattgtttttgaactgtcttaaatgttctcccaaagatgctacagaacatagcctatccatttaccaagttaaaaggctgagtaggactgtgagagatgccctgctcatcatcattcttcttccacttccagtgactgctcttatattctttgccataagccaacaaccgctcatcccaagatctcataatccctctgtaaaactgatgctgtactacataccttgccagctgggacttgtaatcttactgtattttctaaggagtgaataatcttgtccaggtaactaacatatttaaagacattttcttctgtggacactgactccatgccacctgttttccaaagaagtggtgaagctgtttctgagaacacctaaaatcaatggttgtacattccaaaccaatctaaaagtgatttccttttgctgtgggtttggttctattactgatttggaaatatacctttgaacactgagatctctgaaactactagacttctagaagtgtaattgtataagaagtctgtttgcagctttaacaaaatgagaaactcttcccaaattaaagctttctttgaagttaaaaaaaaaagaataatgtgagattggaacctgtgaggtctgaggattcccaagagtactctcaattctgacgctaattgtaacctaagggctccccaacagcccttcacttcttatgattccctagaaaaactcacataactccctgaaacctgtgacatttattgatacaaatttttacagcaaaataatacagattaagataattcaagggaagaggcacatgggcagagttcaggagaattccaagcacaagcacccagttgtcctctcccagtggagaaatagacagtgcttcattttgctcacagcaatgtgtgattctgtgtatgaaacacctatttcctgggtgagccaaccaggaaagctcacccaagcttggtgtccagagggcttttaaggggtggtctgggtgagagtggggttattatgtagaccttgtggatcatcctcaaggctcacttcagtttccattgaattaacaataaaacttaaaccttcaatctttggttattttctttttaaaaattctctgaagtaaattattattaaaattctcacttaagacagctgtttatccaatatgaggctcaatataaacagtttcaaaaagtcagtaggtcattaaaacaatttcttcagtcattcaaaccattcagataaaaattaacaccatgtaatacaaaaattgaattatagtcacagggacaggatttcagcaatggcaagaaaaagtagtgcaaataggaatgagcaaagaatagacaagtaatgggtgtgaattggcctcggaaataccatggtaatgtcaaaaagataaatcaattgttattttgttaaataagtgaaaggccaggcattctcagtccaggaaagccatcacagggcagtctgagtcttctgcatcttaagaagctcaagaggttcaaacttaataaaccctgcacagttgctcactggttcatgtaaaatgctagagcagttgcttcctcccactcagcaaatccacagcacacagtcaccctggtctggcccttcacagtgtagatgccctcagggctaagaacctgagtggttctaaaagtagtaaagatttgcataaagtaccacacaacacaccctctccacatagggagctcagtaggacataaagagccatcagaatccagccccgactctggagccaggagtcccttctaatatcagcatcatggcctggactcctctccttctccttctccccatgtacctcctcacttgctgcccaggttaatagagatttcaaataccagcctttggagggattcctgtgtctccctttctaattcccaacatgtgtctgttttttgtttcagggtcaaattctcaggctgtgatgactcaggaaccctcactgactgtgtccccaggagggacagtcactctcacctatggctccagcactggagcagtcaatgggggtcattatccttactggttccagcagaagcttggccaagcccccaggacactgatttatcatgcaagcaacaaacactcctggacccctgcccagttctcaggctcagtccttgggagcaaagctgcccagacactcttgggtgtgcagcccgagaggtgaagctgagtactactgcttactgcaccatagtcgtgcttggcacagtgacagactcagaagaggaaccgagacataaacctctctaggcccttgtgatatgaagatcatatgatcacgcacaccagctctcaaggcagcctacatgtggaccagccatagaaaggggaaggaaaggatctgaattgattcctatccctgcttaagccctgaagtgaaggaaatgtgagaatgatctgggaagaactggatcaaaaaaaaaatcagaagtttattgctttgtattctaaaaggagcactaacagctggatcagatctaaaggctgaggctaaatgcatttcctccagaaagaagcatcttcaaagtatggggtttctgagctaagagtaaagagaagaaactctacttttgtatatttctaaagtttgttttattgagttactttcaaagcaatacatgcctattatgtggaatcagaaagtattaaaaatcaccaagttctctgcaaagctaccttatcccagataatcaatagaagtacatttcttcatttggatgcattctctcatttttgttgtcaatattttcacaatggttatcaaaccttgtgctcattcctctggttttatacagctttttgctctgtcatttaatgttaatgtaagtagttttccatttatttgaaagggtaaaatatttgagtagttgctaattttatttttatttgaataccaatgaaaaattataatttggggtaattcaaattgcttgtcagacaaagatgtgacattgggctattattaaaatgctcctggtcttctctgtggatttagtgaagtcaaacaaaatgcctgcaattttctatggaaagccttgagtacattatgcctgacttcacaatgcagaaaatagagaaacaagaatttcctgctcatgtttgctggagcataatagattcaggtacgaggaacaacttatattgaaaactacgtcaatgtctccatgcatgtgttagaacagtacttcccaaactctattgtgcatacaaattatctggggattttataaaatgcagattcttattcagtgggtctggagtgaggacacaatctctgcatttctcacatgtgcctgccacacaaaatccacatatatatttgaataataacaagtccagccagcagtggaggctcatatgtgtaatcttagcactttgggaagctgaggcaaaaagattactcgaagccaggagtttgaaaccagccaagagcaacatagcaagatattttctctatagttttttttaaataataaaaaatgaattagccaggcatagtgctgtatgcttgtagccctaagtactaaggaggctgaggcaggaggagagcttcagcccaggagttcaaacctgcagtgagctatgatcatgccactgcacttgagcctgggtaacagagtgagaccttgtctctaataataataagaaaaacgacaacatatccataagactagtatcaaataaggagaatccttggcaggcaagaacctaggagaaatctctgacatagggaatttaccagcttgcatgatagaagaaccccacactccatggagggagatgaccagggaggacagctgcaaagctaggaaaggctcccctttctttgagagcaaaaacaaaagcaaacaaacaacaaacctgaccttccctctggctcctgtccaacactcttactggctcctccttcagcctttcctataatgtggcccatccttaccctctccccttccacatctctgattcctgaattcccttctttgttctctttccctttgctaccacccacttctcccctctaatctcttgagttaattatcaagggctttataacaggaaactcattggcattttttctgcatctgtccttgaagttgacactcatacttttatctctttcttgaacctctcagatatgcttagaactgaagaagcccgaagttgattgattctgttttttcacctcagccagcaccttcttcttctcctttccaggagaatctgtatttctctgtatttccagaattctctgtatttccagtgaatctgtcagacacagtaagtactcttcaaaggtttaatttctgacttcattgttctttgttctcgagatgaacttccttgtcccttctcctaagctacctgctctgtaaacaacttctcccaccagtcccaatctgtaactcacatctcctccttatttagaaagagtcctcttttactccttgctacccattctgtaaactgcccctcccacaaaactacccttcccacatttgccatgccctgacatgcccaaacataccttgtaccataatggactgcctctcccttcccacctaattagccatactcaattttaaacagtagccaatcaggtcagtttagattgtgtggtccaactccagccaatggggacaggacacagaagcagggactaaccacgttagggatgaaaaccccttccctcctttgtttggtgtgctcttgcagtggtcagaagtgcaagcggcactcttctgtagaaataagtttgccttgctgagaaatattttgtctgagtgctcattttccttgcgactctgagctcttgtttctaacaaaatagggggtcatctgggattcccattctcctctgaggaagggcctctgatcacctcttaggaggagatgcatcccactgcttcattgcagtggcctcaggggtaaggaatcaggacccacccagcatgataaataaacccagactctcagcaacacaggaagaaaaggcctacagttaccgtggcgaccaggtaactgtgcacagacaaaggtaagaaaaaccactagggcagtgaagtacttccttagtggtcaggacattctgcaggttgaaaatgtgtgaatgagatgcacaattaagtgcaaagtgagtgtggagtaaagtaaagggtgcaagaaatctctagtaagagaggttgagccccagggaaatggtgcaagaaatctctagtaggagaggttgagccccacgcacactcagcagggaaaggagagcgagaaacctccagtagcggggattgagcctccagggaaaagggtgcaagaaatctttaatacgagagattgagcccccattaacctccaagacgggagtgcaagaaatctctaatatgagagatatgagcccccattaacttccaggatatgaaataccctagtaaaacaagaactacaaagggcaaaggagataacacaattccctctgatagccttctaggtctcatgttaaaatattggagggataatgaaaggactaaacacaagaaaaagcaacaaatgatcaaatatgggaattgttttatttggaccaaagaacctattctcaaaccttcagttttctggccaaggtttggatcaaatgagagttggatttgtcaacttttaatagagtatgtaaatgacaaaagtcctgcttcccaagaggaaatagactctgctgtgtcttggtggcaggggccggtcctcctctacccccttaaaactagtaaggataagccagaaactaattcccctgtaggaactaaggccccacccctgagcaatccatgtgggatcccttagaccatctgcctccaccagatacccctaacttctctcaagcagccacccagacccttcccctgctcacattatgccctccctccttataatcctgactgttagggctgtccccaacctgaacgccctcctgcaagaaggcttcaacgtgagatagagcaatgtaaaaaggatattcaaaacttccctttcccctcctcctcaaaagagtctgccccaatcgtttttcccttaagggaagtgtttctaggaggagagggagttggctttgtaaatgtccccttaactagttcagaggtcagaaacctgagggaagaacttaaaccactattagattatccttttggggtcgtggatcaaattgaccaatttgtaggatcacaagtatacacttaggctgagctaatgtccatcttaagtgttctctttccgggggaggaaagaaccatgatacagaaggctactatgatagcctgggagtgcaaatatcctcccagtcaaaatacccctgcagcagaacaaaaatttctggcccaaaacccccaatgggataataacaatgcagccaactgagaaaacatgaaagaccttagggaaaaggtagttaaagggattcaggaatcagtgcctcaaacccaaaatatttcctgagcatttaatatacagcagggaaaagaccagggagccatggagtttttaaacagactcaaggaacagatgagaaaataggcaggcttaaacataaaggatccccttaggcagggatgttaaaactccattttgttactaatagttggccagatatcatgaagaaattacagaaaatagagacctggaaatatcggcctatagagggaacaagagggcagggagaggagagagaaagactgacagagggaacggagggagccagggagagagggggggagatacaaaggcagaaagagagagagggagggagagacagagaggcagatagatggagaggcagagagacagtgaggaaaagtcagagacccagacagagagggagagaaagagaggcagagggagagaaagaggacgaaacaaatgtttcaaatgtgaaaaaataggtcacttcaaaagagaatgtcctgaatgggaaaaagaaacaaaagtcatatataaaagcagatcagctaatattaaatttctgttaattccagaggcaggaacatatctattagggagagatttaatgctaaaatttggcttaggcctttatattaatcagggaaaatttctcatctccttaaacctactcaccaccacggatgaagagcgtatccatcctgacacatggtcaaaagaagaaaattgggggaaattacagttcctccaatcaagcccaaattaaaaactcctggggaggtagtaaaaaaccaaaatctttcttttgaaagctgagggaataacctcacagaccaaatagccaaacaagctgccatttcctctgaaacgcccatgtttcacctcaccccttgcctttctcccccaaccgccattgccatcttctcccctgctgaaaaggagaaattaataagaataggaaccaaggaaaactcagaagggaaatgggtgttaccagatcaaagagaaatgctatccaaacctctcatgagggaggttttatctcagctgcatcaaggaacccactggagacctcaagctatgtgtgatgcagttcttagagactatggatgtataggaatttatactctagcaaaacaagctacagatagttgtttaatatgcaaaaaaactaataagcaaaccctaagaaaaccatcctttggaggaagaaacccaggaaattaaggccattccaaagcatccagatagattacaccaaaatggcctcaataggtcacctaaagtatctaccagtaatagtggatcaccttactcgctgggtagaagctattcccttttcaagtgtagccaccagtaatgtagtttagacattaactgaaaatattatacctaggtttggattaatagaaaatattgattcagataatggaaactatttccctgcacatgtcattaaaaagctagcccaagtattacaaataagatgggaataccatatccctggcacccacctttatcagaaagagtagaaagaatgaaccaaatcctaaaaagccacctaatcaaactagttttagagactcgactaccttcctattgcctaattgagggtccgaactgcccctcggaaagatattggcttatctccttaagaaatgctatacgggttgccttatttacactccactgctgacattcctacatttgaaactaaagatcaatttctcaagaactatataattggtctgtcttccactttctcttccctcagaactaaagaccttttagcactgacaccacccttggagctcccagcacatcagcatcagcctgggatcacattctcatcaaaagctggaaagaaggaaaactcgaaccggcttgggaaggacactatctagtgcttctaactacagaaattgctgtccgcacagctgaaaggggatggacaccccacacacaagtgaaaggagtgattttcacagcgagagaaaaatgggccgtcaccccagggcccacccgcaccaaattaaaaagggctgaataatcatttgtttattttcccttttctttccaacagaaagtcacctcatcatcagtgtgcctcaaactaatcgtcccttaaccctccagttcgatgcttgttcagtcacctcatgtagagatgaacgagctcaaaggcagctatcaaatgtagataagtatctgtgtccgtaccgtagtgagtcaaccaagtataagtatagagccttaaaaagtccctgtggtgactggacagatgtttggtggaccacccaatatggagggtggacagccaggccccctttttcaaacaattctgaggactgaaacagaaactccaacttattcgtggtaccaccccaccaaattgtaagtcattgcagtgtaaccccttattgctaattatagataatccccaaacaatgacccaagaaccctccatattcgaatgatatgggttaggagcagatgttacaggacaggaccccataggaatcttctttctgaggttggctagaccatcagttaaaaacaataaagaaatccagacccagagtccagggaacctatgggagccaatgctctccccaaacatatcaggctcagcattctcttctcatctccagaatgacccaactaaggtaatggttgtggaggtaaaagatttaaagcagactacagctctagagacagggtacaaagacgcaaatgcctggctggaatggattaaatctcctgtccacactctaaacaaaagcaattgttacacttgtgcacatggcaggccagaggccctgattgtcccctttccacttggaaggtcctccagccaaccaggcatgaactgtatggtagctgtcttccaacaccccacagcctggggtaatgaattatgctgaactctctctctgctatttcctgaagtccagcaccctgtgggtcagcccctgagggccatccagcttctgtctcctgatgcaagtttcaccccatgtctctcacgacaaggggaaaacttagcatttcttggagacctaaagggatgcagtgagcttaagccattccaagagctgatcaatcagtctgccctgatccatccctgagcagatgtatggtggtattgctgcggaccattactagacacttccaagtaactggagtggcacttgcactctgatctaattggccatccctttcactctgacattttgtcaaccaaaaaggataaagacaaagcatcataaaacaaaagatgctcctcatgggtcctttgactctcatgcttatatagatgtcattggagtccagagaggagtgccagatgaatctaagccccaaaatcagatagttgcagggtttgagtccatactattctggtggttgactgtaaataaaaatgtatattggataaattacatctattacaaccagcaaggatttgttaactatactagagatgctattaaaaggatagctaaacagttaggacccaccagccaaatggtttgggaaaatagaatagcattagacatgatactagcagagaaaggtggagtctgtgttatgagtggaactcaatgttgtacttttatacctagtaatactgctcctgatggaaccataacaaaagcattacaaggtcttactgctttatccaatgaagtagctaaaaattcaggaataaacgatcccttcactaatttaatggagaaatggttcagcaaatggaaaagacttatgtcctcaatctttacttctcttgacattgtaataggtttgcttattcttgtagaatgttgtatcataccctgcacctgaggcctactacaaaggcttattgaaacaactctcactaaaacctttttcaaatccaccgcccccccaccttattcagataagctcctacttttagaaaaccaagcagaacaacagagtcaaggcatgttaaaaaggtttgaagaggaagaattataaaaatcaaaagggggaaactgtcagatacagtaagttcctcttaaaaggcttaatttctgaattccttgttctttcttcctgagatcaacttccttgtcccttctcctaagctacctgctctgtaaacaacttctcccaccagtcccaatctgtaactcacatctcttccttatttggaaagagtcctcttttactcctggctacccattctgtaaactaaccctcccacgaaactacccttcccgcctttgccacaccctgacttgcccaaacgtaccttgtaccataacagacagcctctcccttcccacctaattagccatattcaattttaaatagtagccaatcgggtcagtgtagattgtgcagtacaactccagccaatggggacaggacacagaagcagggactaaccacattagggatgaaaaccccttccctccttcatttggtgtgctctcgcagcagccagaggtgtgagtggcacccttctgcagaagtaaatttgccttgccgagaaatcctgtttgagtgctcattttccttgtgactctgagctcttgtttctaacaaatccagtgaaccacacaaatatactagccaattttctccaatccccaccattctgccttatgtgctgatctagtgaggaatcaaataggaagagagacccatggatttctatgcagcctgggaagtgagttcatggatgcactcagttgtaacaccagacacctgtctgccgtttgctgtttagcattcacagggcccagcagctgtgtcctcccagggtgcctggagcatcactgaccacaccctcctacctcccacccacctactcctcaaaaagaaaaatcagactcggcatcttatgtgaggggcacagccaggggtcaggatagatttccactgagtcccctcccctaagagacaccagggaagaggggttgttccgcctaatctatgtggctcaggaagcagagcactacagacatctctaccatggcctggaccctctcttcctcaccctcctgagtctctgcaaaggtggctgtgacatgactctgatgactggagaaacaccagggtcctttgtctcacactgagaaaattagtgacatggacacacattgagtggttttaaggaacagaaagtttaataggcaagaaagaagaaaacagctcccccatacagagggaggagggatcctaatggaaaatcccacatgcaatggaaaacagctgattatattgggaggctggaggaggcagtgtctgatttgcaaagggcccaggggattggtttgaccaggtgtgacattcatgcagcctgtaaaaaaaactggccctcccaccttagccttttaatatgcaaatgcaggtcaccatgatgtcctgcacatgtggcttttatctggaggctgccatgacacctggcacacgtggtgacaaaaagaggagggcgaaagccaccatattgggtggacctggcttctagccaccagcatttgcatatcagtgcttgccagtctggtttttcaagctgctttctgttagcaaagaaatggtttgggggtcgctttttattaaaggaaaattccaccgagaacttacaccatttctagctgcctaaaaattatttcttaatgactcctgttatttcccccctcaggagaagtaaacctaactgtcgttaggggatgttggacaacaattctttctggctacttccttctggaaaggggcgtcatgtaaggggacagcagttgggcctcctcctgaggttgatctaaggattctctgaagaatggcatgtccatgtgtggctctgtctgcagcattatttggagtttgattgcttctaggtgaaaagagataaatcttacaagaaggtttaaaatatagggttagaatatgagtattaagattaccactgttagtgggggtactatagaccacaactatgacagcagagtttgatacttgttagttacaccagtggattgtaatactgggttgtctccactagatgtcactgaatattaccagaaagattaatatgaaagtgacatttttccttgagaaaaccatacatttccccctttacttgccattagtgaatagttttaggcttagaccatttttataacttgcaatataattgggagaaatacattattgggtggctaaattaactttagtgttaatcttgacaattccttttctttaattattaaattatttcatgactttcacagaccctcttacaacatactcaaactttccgacttgtcctaaacatccttcctttaaataaccagtcatttgcttttaggacaagaatttcccacacaagatcttttcttatataaagttccttcttttataaccttctttctatagcttagagtgcaccatacaaccagtcttcaataaaaagtcctatcaaacttaatgatagtaaaactttcatgctatatccataactattactcctgctataagcaaaacagccttgactaaatctttcctgcaattgttaatcctgttataaggatgataattagacaagatgttacagcaattagaattttacaaccagaattccacattgtgagtgccatagtgtatagttctattgcaaatagtagtgtgactgtaacaattcccacaagactggcatagtaaataatttccattgaaaactttacttgccaagatataacatttccctttgggaatctacaaggttacaaatgcaattctatgaataatcaaaatctccctgcgaatatgcattaaaaagaagttctaatatttggtggcaaatttttagaggaaggggtacaaataataaaaagtggccgggcatggtggctcacacctgcaatcccagcgccttgggaggctgaggtgggcagatcacgaggtcaagagactgagaccatcctggccaacatggtgaaaccccatccctactaaaaatacaaaaaaattttgggaggctgagacaggtggattatgaggtcaggagatcgagaccgcctgtagtcccagctgctcgggaggatgaggcaggaaaatggcatgaacctgggaggcagagcttgcagtgagctgagatcgcgccactgcactccagcctgggcgacagagcaagcctccatctcaaaaaaaaaaaataaaataaatagctgggtgtggtggtgcatgcctgtaatcccagctactagggaggatgaggcagaagaatcacttgaacccgggaggcagaagttgcagtgagctgagatcatgccattgtactccagcctggtgacagagcaagactctgtctcaaaaataataaataaataaaaagcatctggtgaggtaggagtgggactgagtaggatgagtagccctcactcagttacttatcttttatgattttcagcttaagatcttctatttctccactttgatattcaggacgttcctctgggctgtcaggggttgctccctcaggcattcaggctttgacttgagtgtgatgtattcagaagttgacacctgtaacttttgctgccaagggggttgaaagagaacagtgtagggcccttcgcagcttggcttagggaaggagagagaggtgagagttttcactagtaccaaatttcctgggttaaataaaggtggttctatttcctggggctgggcttctgccagttgtgtcaatttctgttggaagtgaggtagagaggttacatgcttaaccaatttataggttttctgcctgaaaacagtctctgagcacattgacaaattttatcctttcctaagtgaaaagcttggtgaaggattttaagaactttccattggctggaggctggcaaatggagtttgccatcctctggctgtagccatcctgagagataaaaagcatacccttgagaagtggcctattctgtttctgcaggaaaatactgaggtttaatttctgttatggagcattcctagattagaagggggcttgaagtgtgttaatgccttgaggcttccttgcctttgacttagctgcctgattaatctatttcctttggctactttatttgctgccttttggtgttcctataatgtatccctgctatttctcacggcataaaaagtgaagataatagcctgctaattttctggtgatattttacaggaaatccattagtggtaagaggatgtctttccttttaaatggcagcatgagtatggagagctaagaaagcatacttggagtccgtgtaaatgttggctacctttcccttgcttaattgaagtgttctcgtaagagctattagttcagctaattaagtgcttgtgtctggggagagatgttgtttagagtgactactgcttatcctgccttatgtatttcttgctttaccggctgttagttaaaagcgccccctaaaggacagtaatcctgccacattacgtggggtgtaaacagttaagttctttcccaggattaatttggaggcttttctaactgtaaagctatcatgacaatggcttggaagcatgtgtaaataggtcctcctaactgcaactaaggttgagaaaaatattgtactagagtttttcctgagatgttccttatggtgatgctatgagaagaggggaggcctggattagagagaagaaaagagagagattggctttagtatttagaaggacatctactttccttcaatttccagaatcacccaggtcctggcaccctgttaaatgtgccacccatgtttgcaagcgtgaccctccaagccatggcaccagaggaactaagcttgtgggcctagtcgtgctaccccaagcagctctagtcctctgcctatgatttccctttgacttcctagacttgtgtgatctgtgtgtctcaccccacccccacccccaaaaaaatagatcttggcagaaactatatggaaggaaaggctcctttaatggagggaatgtgctagattgcctgctattatggcctgtgctaaagcatttacccttagaaaaatggttccagttaacttccagacttaaaatctccttactaattaagtactgttttaatcggagagagaacaggtgtcttaaaggaacgcggggacctaatggcgactttcctgctaatgggacagtatcggggcacaaattcggctgcagaggaattttactcctaatagttaaaagcagaattttcccgttcacaggagcagcataaatcctggtttccagtagaaaggtgcaaaaagaaaaaaattgagaagctgcggtgtaccgcggagatcagcaatgtgtcgcataaagaggattttatttccactaggtggcgctgttggcctagaaataccatgtgctcaccagaggaattttagggagtaacctcactgaggggcaaaggaagacttctgttcctagaagattgcaatggcattttcctgagctatctccccagttactacagcattttctgatcttgcctaccaggattacttccctacgctgtaaaaattcccgcacatttgacacacagagagagtaagagacataacgaccacggataaaaaaggaagaaggttctgcgacaggatagctagggatcctttaccaacatccagagcaggccgttggaggctgggtccagtcccgaaacctttgaataacaccaggctgtgccctggccagaaattctcagttgcttcagaacttttcccagcctcacgcgatggctaagtttccccatgaaaagaaactgatttgaagcatgaccaacattcccaaagacccgtgagtattgcgggttctccgtgttctgaccagcaagcctaacactcaagtctttagaacaacagccatgataagcgtatttagacggccaatggatgcccataattgatttgattttgattttaaaatagagaccaagaacctctgaatgacagaacagactttgagttcactcctctaatcactacgtcgatgaatgttgtaccttggattcccagtgaaggcaccagaaaggatacggctctgatgactggagaaacaccagggtcttttgtctcattctgagaaaattagcaacatggatggacatatgtggagtggttttaaggagtggaaagtttaacaggcaagagagaagaaaaacagctcccccatagagagggagaagggctccgaacggaaaaccctacatgtggtggacagcagctggttatattgggaggctggaggaggcagtgtctgatttgcacagggcccagggaatgagtttgaccaggtgtgtcattcacgcagcctgtaaaaaaactggccctcccaccctagccttttaatatgaaaattcaggttgccatgatgtcctgcacatgtggcttttatgtggaagctgccgtgacacctggcacatgtggtgacaaggagaagagggcgaaagccaccatattgggtggacctggcttctagccaccagcatttgcgtatcaatgcttgccagtctggtttttcaagccgctttctgttagcaaagaaatggtttgggggtcgctttttattaaaagaaaattccaccaagaactttcaccctttcttgctgcctaaaaattatttattaataactcctgtagtagctggagacaaggaggcagggatggcactgggaggaccagggctcttccttgctcccctggcttactgagccacctccctcaccctgtgtctctctcctgactctcagggtcctgggcagtcagaactcacttggtaacctgcacagtctgtctgtggctaaaccagtcaccatctcctgcactggaagcagcagcaataagggtcttgggattgtgtcctggtaccaacaatgaacaggaagtgtccccaaacctctgatccatagaagccaatatacacttttagggatgtaggactgattctcaagctatcagttttccaaaaaggccttcctgagcatctctgggctccaggatgagaacaaggctgatcactaatgttggcattagtgatcatgtttgtgatttgctataaaatcatccagcgatggagtaagatgatgggtaaaaagggttgaaagattaaacaagatgagtcacactgatgatgtcaaagctagctgatgggtgccaaggattcattagacaactctcagcatatttatataactcaaaaatttccataataatcactgcctaaaaaaatccatgtctgtgatgagaggtatatgtcctgcttttaattggtatgtaacctgattttaacaatgtggtatataatctgcttttaacaacgtggacaaaatgtaagcttacattctgacttcaagttgaagcccatcttctcctaacaggcaaaggaggagctggggtggaggctatgaaagggaccggagctcagcgtttcccaggacaaagaagtgagtgaggccggagtcccagcagaaggacgaggggctgtgagatgggctatgggagtgtgcaggggccacaacgtgcaggtcatgctgctggggccacaggattcaggttttatataaacaacaaggagccactgaaggtgtttaagccagggagtgacatgccacatctgaatgagaagcatctctctgaattccttgaggagacagtgtctgaaggaagtgagtgacctgattctagattatttactaaagcaccttgtaagtctagaaatccaggggccatttacaattagcacaagtgtagatgtgggctacattgaagaagtgatggtctcttgtcattcttcacagaactagaaaaaacaatcctaaaattcatatggaaccaaaaaagagcccacatagccaaagcaagactaagcaaaaagaacaaatctggaggcatcacactacctgatttcaaactatactataaggtcatagtcactaaaacagcatgacactggtataaaaataggcacatagaccaatggaagagaacagagaatccagaaataaacccaaatacttacagccaagtgatatccaacaaagcaaacaaaaatatagagtgggaaaatgacaccctattcaacaaatggcgctgggataattggcaagctagatgtaggagaatgaaactggatcctcatctctcaccttatacaaaaatcaactcaagatggatcaaggacttaaatataaaatctgaaactataaaacttatagaaaataacatcagaaaaactcttctagacattggcttaggcaaggatttcatgaccaagaacccaaaagcatatgcaacaaaaacaaagttcaataggtggaacttaattaaactaaagagctaaagaaaaaaaagagcttaattaaactaaagagctaaagaactaaagaaatcaaaataatcacttatagaatgatgaaatcggtgtctgggaatcagaacatggatgtgtgaatacagacagtgactggtgagctgcatggcaaaaggaacatcagcagagtaaacagacaacctacagagtggggaaaattcttcacattctatacatctgacaaaggactgatatatccagaatctacaaagaactcaaacaaactagaaagaaaaaaaaaactcatcaaaaagtgggctaaaggcatgagtagataattctcaaaagatgatatacaaatggccaagaaacatatgaaaaaatgctcaacatcactaatgatcagggaaattcaaatcaaaaccacaatgagataccaccttaccacctgcaagaatggccataattaacatataatagatgatggcatagatgcagtgaaaaaggaacacctctacactgctggtgggaatgtaaactagtacaaccactgtggaaagcagtgtggagatttttttaagatctaaacatagaactaccatttgatccagcaatcccactactgggtatctacccagaggaaaagaagtcattatacaaaaaagatatttgcacacacgtttatagcagcacaattcacaactgcaaaaatgtggaagcaaccaaaatgcccacaactcaatgagtgaataaagaaacaatatatatatgatgatatactactcagccattaaaaggaatgaattaatggcattagtagcaacctggatgggattggagacttattctaaatgaagtaactcaagaatgggaaaacattgcatgttctcactcagaagtgggagctggccaggagtggtggctcaagcctgtaatcccagcactttgggaggccgaggcgggtggatcacaaggtcaggagatcaagaccatcctggctagtgtagtgaaaccctgtctctactaaaaacacaaaaaaattagctggccatggtggtgggtgcctgtagtcccagctactcaggaggctgaggcaggagaatggtgtgaacctgggaggtggagctttcagtgggctgatatcatgccattgcactgcagcctgggtgacagagtgagactccatctaaaaaaaaaaaaagaagtaggagctaagctatgagaatgcaaaggcagaagtgttacgggaagtcagggaccccaaagggagggaccggctgaagccatggcagaagaacataaatcgtgaagatttcatggacattcattagttccccaaattaatacttttataatttcttacgcctgtctttactgcagtctctgaacataaactgtgaagatttcatggacatttatcacttccccaatcaatactcttgtgatttcctatgcctgtctttactttaatctcttaatcccatcatctttgtaagctgaggatgtgtgttgcctcaggaccctgtgatgattgtgttaactgcaaaaattgtttaaacaacactaaatctgggcaccttgaaaaaagaacaggataacagtgatgttcagggacaagggagataaccattaggtctggctgcctgagagccatgtggaacagagccatacttctcttctttcaaaagcaaataggagaaatatcgctgaattatttttctcagcaaggaacagccctgagaaagagaatgtgttcctaggggtaggtctctgaaatgaccgctctaggaatgtctgtcttttacagttgtagataagggatgaaataagccctggtctcctgcagcgctcccaggcttattaggatgaggaaattcccgcctaataaattttggtcagactagttgtcttttctcaaaccctgtctcctgataagatgttatcaatgacaatgcgtgcccgaaacttcattagcaattttaatttcactccggtcctgtgatctcgccctgcctccatttgccttgtaatattttattaccttgcgaagcatgtgacctctgtgacccacaccctattcatacactccctcccctttgaaaatcactaataaaaacttgctggttttgcagcttggggggcatcatggaacctgccgacatgtgatgtctcccccagacacccaactttaaaatttctctccttccctttatttctcagaccggccaacacttagggaaaatagaaaagaacccacactgaattatcgggggcgggttcccctgataagaagaatgacacaatggactttggggactcaggaggaaagggtgggaaggagggaaagtggtaaaaactataaattgggtacaatgtatactgctcgggtgatgggttcagcaaaagctcacaaatcaccactaaagaacatactcatgtaaccaaatatcacctgttgatattactcctatcaacattactcctacctgtgtctgtgtatctttgtcatgtgacttatcccccttgactttgtgcttggccctgttctcactttgagtaatggaacatttgtggaccttatgcaagctcaagtttaaatgtccttgcaccacttggtttgccctcttttgcaactctcattactaagatcttgtcctggatagtttttggcccttcaggctgggtttccaaataaacacgtgtgagtaataaatgctgatatttgtgactgttacatagcaatatatgaatgatacatctaacataaagcagacactggatattggtgtggtgagtgaaaacactcaggcttgtatgtatgtagattcctctcccacagagggcagtcatcaatattaccaactcaactaagaggatgattcttatttggtgcagtttctctaattccaagagcagtggagaagtctaataccagggcagtgagcacgaccatctgaacaactcttccttttatgctggccctgacgcatcctaacaggccaagaaacttggaagtgcctccctggaggcagctgggagagtgatgacagatcgggctacgtgggtgatttatttatattcttctattgtctaagatggatatgtttatttaaaattggaaataactgctataattaaagcattgaataaaactaaaattaagaattaaaaatttatatattctccaacatcctatcagtcaaagaaaattacaggtgggtattaaattgtcagataaaagaagaactttcagagcaaaggaaagaaatgaatatttataatctccaagcattgcatgtatattttctctaattctaccatttggctacattttaaggtgccctaaaatttgctttttttttttaaattttctttcgctttccaattctatctcattatcacccatgaagtcccatctttatttttttaacaacaaaatattaggagaaaattaatcatcatttaatccatttatttttatttatttatttttgagatggggtcttgctctgtcatccaggctggagtgcaatggcacaatcacggctcactgcagcctctgcctctggagctcaagtgatcctcccacctcagccttccaggtagctgggactataggtgtgcgccaccacacctggctgagtttttaaaatttgtatagagatggggtctcactgtgttgctgaggccggtctcaaactcctaggctcaagcaatcctcccacctgaacctcctaatgtgctgggattataggtgggagcaataatcatttaatctaaaattctctcagatgagtaggtatgggaaaatttttaaaaaaataataatattaaaataataatataatctaaaacctttttttcacaaatatatctcaggcccaaattttcatccgtccatccatacattcatcaattcattcactcaaccatcaaacatttatttatttatttttttgagacagagtctccctccattgcccaggctggagtgcattggctcgatctccactcactgtagcctccgcctcccaggttcaagtgattctcctgcctcagcctcccaagtaactgggactacaggtgcaagctaccacacttggctaattttttgtatttttagtagagatggggtttcaccatgttagccaggatggtgtcgatctcctgacctcgtgatctgcccacctctgcctcccaaagcgctgggattacaggcatgagccaccacacccagcccatgaaacatttattaagggcccattctgggtgacatattatgttaggttggactgtgagggtataaatacaggacaaatgagaagggttccttctgtcaaggagaacacactcgaagatactagaaataaaatagaaacttctacgctaattactaatacagagaattaccagatttttgaaagctcaactaataaagcaaccacccttttctggatatatcaagaaagtgtctgccttggatgtgggatcttagaaaaagaagagtaagtatggaggaaatgaggtcatctccaacagagggactgtgtgatagtatggactgcatatttctgtctcccccaaaattcttagattgaaaccctaaccccccatgtgatagtatttggaggtagagcctttgtgaaataattaggtttagaagaggacatgagagtggagccctcatgataggattagtgtccttaaaagaagaaaaagagactagatctttctgccatgccaggctacagagaaaggtgccatctacaaaccagaaagtggaccctcgccaagaaccaaatctgcaggcaccttgatcttagacttcccagcctccagagctatgagaaataaaggtttgttgtttaagccatccagtctttgctattttttttatggcagcctgaactaagacagcctggcaaacacaggaaaggaagctataaaagggcacaatgggctgggtgcagtggctcacgaatgtaatctcagcactttaggaggccgaggcaggtagatcacttgaggccaaggagttcgaaaccagcctggccaacatggtgaaactccatctctacagaaaatacaaaaattagccaggtgtggtggtgggagcctataatcccagctactcaggaggctgaggcagaagaatcactttagcccaggaggtggaggttgcagtgagccgagattgctccactgcacaccagcctgggcgacagattgagactccgtctccaaaaataaaaggcaccaatgactgtgtgttgagtgaccaattgtgttgagccatagaggaaagatgtaggcaccagtgacttgtccaggatcagggatgacacacttctttttcttgatagctattctgtcctctcccagacattttttttttttttttaacactgctgtcgcccaggcaggagtgcagacatggctcattgcagcctgaacctcctgggctcaaatctcccacctcaggctcccaagtagctgggaccacaggcatgtgccactatgcttggctattttttttttttatgtttcgtatagatagggtctcgctatgttacccaggctggtcctgaactcctggcctcaaatgatcctcctgccttggcctcccaaagtgctgagattgcaggcatgagccgcctcacctggcccctctcccaaactttcttttgaggttaaataatgtaaaaaggaagagtgtgtagaacaaaagtaatagctaatgtaaaaaaaaaagtttaaaacaaaaattatccatatctcactacttagagataaccattatatatattttgacaacaaatacccttctggatttctgcatttgctctgtcagatgttagttgaggtgggacagggaaaggggttaagggaggaggcaaggaaagaagggtcagaatgcaatttatcttacgaggcgttttcccatttagtaatacataatcaacatctctgcatgttttcaagtatataaagctccttagatcattacttattcatagtattacagggattctatgttttctctattataaactacatgttgttgaacttctttcaaactacatctattcatacagcaagtcatttactttgtaaaaattcctaaacttaaatatctggttcaacacaagtatgcaaaattttgtacagattttatttaccatagaactatggctacaaattaaatgaaaataatagtaataaattataataatataggagtcacctcacagatgtttccagtcacaaagtaaggcttttcctgctttgtacttaagttgaaatccccccaaagtgcataaaggcggatacatcctttctagggtacccttttcaccctgtagatgaaccctgacgtggccaactgatctaccgacagtagtacactctagatgtcttttattaaaataatagataatagagtaatccacaaactaggaccttacacacatacgcacagagcaaaagctcctgaggtgcagagcctacaggaaacctcatcaaaagctctgatggctcctgtcgatgagcacctttaggaggggctgctgttgtcttaagtcagaacagagatagtttgtgcctctccattttgaaatgctccagatttcccttccctgtcttggtctctcagagcctaatgtctgtgctggactagcatagtcagtctttggttatgtgtctgtattttctatttaaagtagtctaggctgggtgcagtggctcacacctgtaatcccagcactttgggaggccgaagtgggtggatcacaaagtcaggagttacagaccaccctgaccaacatggtgaaaccccatctctactaaagatacaaaaaattagttgggcgtggtggcgaatgcctgtaatcccagctactcaggaggccgaggcaggagaatcgcttgaacccgggaggtagaggttgcagtgagctgagatcacaccattgcactccagcctgggaaacagggcgagactccatctcaaaaaaaaaagaaaaaaaaaacattagtcggggtggcggcgggcgcctgtaatcccagctactcagaaggctgaggctggagaatcactgaacccaggaggcagaggttgcagtgagctgagattgcaccactgcactccaacctgggcaacagagggagactccgtctaaaaaactaaaataaaataagatactctaaagtaaattatttaaataattctcatcttaagcaagcagtttattcagcatgaggttcaaagtaaataacttcaaatcagatggtcatgaatataacttctttagtcattcaaaacactcagataaacaagacggataacactgaaatgaaatacagacaatgcagtggattttcaacaataactacaaaaaggactgaacaaagagacaaacaatgaatgtgggcttgcctaggaaatacagtagaaatgtcaaaaaaagttaaatgaatgagaggggtactacaatcctccaccccaggaaaccacagcaaggtgccgtggatcctctctgaagcctgacgttcaggttgttcatattttaggtaccctggacacttgctcataggccctgcaagaggttacagcagctgttccctcccacagggcaaagccagatctcacagccacctaggcctccccatgacagggagttgctccctgggacaaagaccagaataggaggaggagggagagataaaaggctcagatttgcataatgtgtcccacaaatacctaacctttatgcaagaggtgaggagggcataaaagagccattagagagtccaacactagctgtgaggccagtgggcccttggaacttcagcaccgtggtctagactcctctcctcctcctcactcagtcactgcccaggttcacagagatttcagatcagcctttagaatgattcttctgccttcttttgggagaaagtgggtctaggaaaaatagaatgcaaatatttttccaatccatagggaacaataagaggtatactagatgaagagtttatggtcaaatattttttcaaaaaaaaaatctctctatgatgtaattctgactgataatagcaaagaaaacaagctccttattttatataaaaaatttttctttttttttttttttttgagatggagtcttgctctgtcacctaggctggagtgcaatggcacgatcttggctcactgcaacctccacctcctgggttcaagtgattctcctgcctcaacctcctagggattacaacctcctagtagctgggattacaggcagccgccacaacgcccggctaatttttgtatttttagtagagacagggtttcaccatgttggtcaggctggtctcaaactcctgacctcgtgatccgcccgcctcggcctcccaaagtgctgggattacaggcatgagccaacgcgcctggcctaaaaaatttttcaaaacaatgcaagtttactacataaaatctggctttttttttttttttttttttttttaatgatgtggtcctgctctgtcattcaggctggagtgcagtggcacaatcactgcttattgcaggcttgacctcccaggttcaagctatcctcccctacctcaatctcccaagtggctgggaacataggtgtgtaccaccacacttggctaatttatttattttctgtacagcctggatccccctgtgttgcccaggctggtcttgaacttctgggctcaagctatccttcctcctcagcctcctaaaattccggaattacaggcgtgagccaccatgcccgacctagaagtatttgtttcaaggagcatatttaactacgccgtaaagaccaaatagttcagaagttagatgttacaattttagtctcttctcctacttcttcttttttttttttttttttttttttgagacagagtctcactctgtcacccaggctggagtgcagtggtgcaatcttggctcactgcaatctctgcctcctgggggggtcaagcaattctcctgcctcagcctcccgagcagctgggagtacgggcatctgccaccacgccggctaatttttgtatttttagtagagacggtgtttctccacgttggccaggctggtctggaactcctgagctcaagtgatttgccccgcctcggcctcccaaagtgctgggattacaggtgtgaaccgccgcgcctggctgttctttcacatattttctccatagttcagatcacaatgtatacaaatttttttcctgctagttttctttcacattactgcaatctatctcttttaaaaaaagtatatagtgcagctatttcagccaggcacggtggttcatgcctgtaatcccagcactttgggaggcagaggcggctgaccacttggggccaatgagtttgagaccagcctgggcaatgtggtgaaaccccatctctactaaaattacaaaaaaataattagccgggcgtgggggcccgcggctgtaatcccagctcctcaggaggctgaggcaggagaatctcttgaccgcaggaggcggaggttgccgtgagccgaaatagtgccactgcactccagcctgggcgacagagtgagtgaggctccgcctcaaaaaaaaaccaaaccaaaacaacaataacgaaaaacaacaaaaaaagtagattgtgcagctatgaaatgaaaagtacaaaactgttcagtttccaggcatttaaaattatttctggccaggcctggtggctcatgcctgtaatcccagcactttgggaggccgaggtgggcacatcacctgagatcaggagtttgagactagcctgaccaacatggagataccctgtctctaactaaaaaaaaaaaaaaaaattatttctactttacatttacattagtacaaccaaagtattgatgaattatcttacatactcaattttggatatatacataaacattcattctgtaaatttttattggatatgttaaaagcatcccatgaggccagcagtggctcacgcctgtaatcccagcattttgggaggccaaggcaggtggatcacctgaagtcaggagtttgagaccagcccggcctacatggtgaaaccctgtctctactaaaaatacaaaaaattagccgggcatggtggcaggtgcctgtagtcccagctacttgggaggctgaggcaggagaactgcttgacccctggaggcagaggttgcagtgagccgagattgcgccattgaactccagcctgggcagcagagtgagactttgtctcaaaaaaaaaaaaaaaaaaagcatcctatgaaaaaaatgaaattattacctttttattcatatattgaaataacttccaaaaaggcttatgccaattgaaactccttttaatacatcctcactgacagtaaacattacaatttatataatattcatcagtacgctaccattgctttaattcccatttttgtttttgctatggagactaaatattttgcatttatttaccaatcagctatatttattctttgtgaaatggacagggatttttttctttacaacaattttataatagtgcattagagatttgtcttagtaatctttttttttttgagatggagtctggccctgtcacccaggctggagtgcaatggtgcgatctcagctcactgcaacctccacctgctgggttcaaataattctcctgcctcagcctcccaagtagctgggattacaggcgcccaccaccatcatgcccagctaatttttgtatttttagtagagatggggtttcaccacattggccaggctggtctcgaactcctgaccttgtgatctgcccaccttggcctcccaaagtgttggaattacaggcgtgagccaacacacccggcccccgatttttcttagtaatctttggaaacacttcagaaatatttttaattagccctttcataatctcaggctataattttcctgtttatatgccataaaatgtgaacatgttacaccgtcaaataaaaaaagcaaggtgcagaagactgtgcataatataaatcagttatttaaaaaaaagaaaagaaaaaataagaaactatctgaaaggctaaaaaaagaatctgagttgttactttttcgatgtttgaagaatgtgaatatattatatactcaacattttaaaataaatgaactttaaaaagaatcctctcaaaatggtgtcagccacaatggcacaccagagagtgggaaggcaacacaatgaccattaactcagttttagctgccttccttgtatcataaaaacttctaatgttccattttccctgtggtaacttccaagatggcctccagtgattccccaccctctggtattcctatctgtatatggtccattcccacatagcatcagggttgctctgggtgaccaagagtatacaacagagtgaagttattttacctccaaggctattataaaaaacattgcaatgccttccttgttctcttttggatcactcattctgtaggaagccagctgacatgtcatgaggaccatatgacaaggaacagagggaggcctcctgccaatacccaagtgagtttgaaagccctagtcaagcctttcacatgatatggccccagtcaacatcttaactgcaacctcatgaaagaagctgagacagcaccactcagttaagtgaccccaaattcctgaccctcggaaaccatgagataacaaatagtggtggttttagttgataagtttgcagtaatatattatacagcaataggtaactaatacagattttagtacctggaagggaggtgctggtgtaatacctaaaatgtaggagtggctttgaaactgggcagtgggcagaagctaaaaaatcttcaaggagattgtcagtgcaagccttagtagaaaactggactctgagaaggctctggtgtagcttaaaatgaagtgaggaacatgttattagaaaattgagcaaggggttacgtagttacgtagtggcagaaagtttagtgactatcacctagtcaggtgaaagtagaaaatgtacctgagtcatctaattgagatttccagccagaatgctgaaagtgctgattggtttcttcttgctacttatagtaaaatctgaggggacagaaacaagctaagggaagaagtgttaaacaaaaaagagccaagagccaatacctgctggttttgaaaattcccagtctttccagatggcaaaagatgctaaaattaactgctcccaagcaaaggttatatccagggcactaaagaaaggtgcagaaatatgaaagatgagggtaaaaatcctttttactttttctttgagacagagtttcacccaggctggagtgtaacggcttgatctcagctcacggcaacctctgcctcccaggttcaagtgattctcctgcctcggcctcccgagtagctggagttacaggtgcaggccaccatgcccagcaaatttttttttttttttttttttttttttagtagagacggggtttcaccatgttggccaggctggtcttgaactcctgacctcaggtgatccaccagccttggattacaagtgtgagccactgcacccagtcagagggtaaaatcctttaaggctctgaaagatcaaaaatgatgcttcagagtacagtagtcccctttatctgtggttttactttccatggtttcagttacccacagtcaattgtggtccaaaaatattaaacggaaaattccagaaataaacaattcataggttttagtttatttatttatttatttaatgacagggtcttgctctgtccttcaggctggagtgcagtggcgtgatctcggttcactgcaacctctgctcctcggcctcaagcaatcctcctacctcagtgtattgagtagctgggattacaagtgcccaccaccacacccaactaacttttgtatttaagtagagatggggtttcactatgttggccaggctgttctcaaactcctgacctcaaatgatctatctgcctcagcctcccaaagtgctgggattagaggcgtgagccaccacactcagccaacaattcttaggttttaaattgcatgccattctggttagtgtgatgaaatctagtgcagtggctctgagttccattcaggacataaatcatcccattgaccagcatctctatgctgtgtatgctatgctcttgtggtgttataatatacattggttttgtccacagttcataactcccacagcccttgttacagtcttttgttataatgttcggtgttaggcctcagaggtaggcttctgaccttctgccatccttttacctgccccaaggcaggactctaatctttctgattgtgggttctaagaccctcccaagagagaatcctgccctatactctagcgggagagaatgcttaagtcatgaagcttccataaaaacccaagaagactgggttcagggagcttccagttagctgaacaacacttggaggttcttggaggttggcgcactcagggaagccatggaagctccatacctctttccacacaccttgccctgtgtgtctcttcatctgtatcttttgtaatatcctttataataaacctgtaaacgtgtttcctcaagttctgtgagctattgtggcaaattaatgaaatccaaagagggggttgtgagaaccccaacttgaagtcagtcagtcagaagttcagtatacccagacttgggagtggtgtctgggggtatggggggaagtctggaggaccgagaccctaacctgtaggatctgacactaaactgttccaggattcctgacactcagagactatgtgagttaatgtttaagctgttagttttgtggtaacctgttatgcagcaacagataacacattcccttccctgtttgcaaagcacacaatcccacccatcaaaaaacatggaaaaatggtactaaggtttcgatgtgtatgtttatacacacccatgcacacatccctcagacagcttttctgtcatttctgacattgtgcctctttctactgttttggattctatcaatccctggataggatcaaggaataaccccatcccattcacatccaaagttctaagccattagcccacatacatgaatacaggggaagatacaaatgagtctaagttataactagagcaggggtcagcaaacttttttctataaagtgtcaggtagtaaatattttaggctttgctgggtgtatatgggtctctggctctaacaatgttttgaaaatttaaacttagcctaaaagccacagtttgccaatgcttgccctaaagctaagaaagacttgtgtcttagtggcagtcttgccacacattgataattgttctaatttcaatctcataaccgggaaggaaagagtctaaaagggctaaccactgaaatggaatttactttatttatatgatgaatgcttttaaaagacaaaataactcacttatataacatttgtctgtttttttgagagagtctcgctccattgcccaggttggagcgcagcagggtgatctcggctaagcctccaccttccacctcctgggttcaagcgattctcctgcctcagcctcccgagtagctgggattacaggcacacaccaccatgcccagccagtttttctatttttagtagagacggggtttcaccatgttggccaggctggtctggaactcctggcctcaagtgatccgcctgctttggcctcccaaagtgttgagattacagttgtgagccaccataccagcatttgaaagaataaaaatcactatgggattaagtaaactcaattgtatttagaatttatcattcttttccatagatgttatcatgaataattacaattgcaaagtacatataactttgtatgttcctttcttattttgcattatagccaaataaaattgtgtactgcaatagctcctataatcactacttttgataactgaatactgtttgtagtaggtatatatttaataatttgactttcagtttggtttccaagttttgggttttttgtttgtttttgaggcagcatctcttgtcacctagtggtacaatcataactcactgcagacctcctggactcaagccctcccgccccatcctctcaagtagctggtcagactacaggtgtgcaccaccacgtcttaattttttttttttgagacgcagtttcactcgtttcccagactggatggagtgcaatggtgcaatctcagctcactgcaacctccacctcccaggttcaagtgattctcctgcctcagcctccccagtagctgggattacaggtgcccgccactacgcctggctaatttttgtatttttagtagagacgggttttcaccatcttggccaggctcgaactcttgaccacatatgatccacccacctctgcctcccaaagtgctgggattacaaacatgagccaccacgcccagctggtttgaatcctttgttaaagaaaattaaaaaataggttaggcatagtggcacacacttgcaatcccaacactttgggaggccagggcaggaggactgtttaagcccaggagttcgagaccagcctgggcaacatagcagaaccctgtctctaccaaaaaaaaaaaaaaaaaaaaaaaaaaaacctcacaaaaaacaatgctaaagaaagcgaatgagatataatgaataaaaacaaaaatagagaaaacaaaactaaagcaaatggggggttgcttcttggaaaaagtaaatcagaaacattgataaaaccaggacgaattaatgacaggaagaggaaatacactttaatattagaaatgagaaaggaagtgggattccgagtagttaaaaccatatcctatcccaaacagaactacttttgcttcaggaaaggaaggtttctaacaagaaagctgtaagtgcaaccaagtaaaaacttgggttagtaaagaaaatgattgtcttaatagatgttgtaaattataaaactaaataattctctttaaagattctaaaaaatagaaatagaaactttttttttttgagatagagcttcgcttgtttcccaggctggatgcaacctccgcctcccaggtacaagcgattcttctgtctcagcctcccaagtagctcggataacaggcatgcgccaccatgcctggctaacttttttgtatttagtagagagggggtttcaccgtgttaggctggtcacaaactcctgacctcaggtgatccacccgctttggcctcccaaagtgcagagattacaagcatgcgccaccacacctggccccaaaaatggaaatagaaattatttaagcaatatacttattacctttaagggcaaatcatttcttattaaagccaagaacaaagaagcccattaactccatcttaaatattgtttagaagttctggctgtagtgccgggcacggtggctcacgcctgtaatcccagcactttgggaggccgaggcaggtggatcatgaggtcaggagatcgagaccatcctggctaacatggtgaaaccccgtctcttctaaaaaaatataaaaaattagccgggcgtggtggcgggcgcctgtagtcccggctacttgggaggctgaggcaggagaatggcgtgaacccgggaggcagagtttgcagtgagccgagatcaggggccactgcactccagcctagctgacagagcgagactctgtctcaaaaaaaaaaaaagttctggtggtagcaataaggctaaaaatgaacacaagtggcaaaaaggcaaagattatacagtggtactaaataaaaattaaaaactaaaaataggccaggcatggtggctcactcctgtaatcccggcactttgggagaccaacgtgggcggatcacttgaggctaggagttcaagaccagcctggccaacacgatgaaacctcgtctctacgaaaagtacaaaaattagctgggcatggtggcacacgcccatagtaccagctgctaggaagaatcacttgaactcagggggtggacattgcagtgacctgggatcgcgccactatactccagcctgggtcacagagcgagactctgtctcaaaaaacaaaacaaacgtcccattttacttatggtggaaagacaatacagcaacaatacagcaacagcatttttttcacaaaacattttattactataattgatattttacttataatttttggcaacattaataaaataataaatttcacctgaaagaacaagcgagcaaaatagacaaggaaattcacaaagggcaataacaaaatagtaatcttgacatattcaatatatttgtaaacaaaacaaagtgacattgccttaaaaatatatagaggtatcaatagaaaaacagagaaagctcctgaaagaactcactatattaattttcatttggttgcaggcacagaaattgactcaagctagctcaattctaagacagaagcaaagcccttgatgctgatcgctttccagctttttcatgaaaacctaggaaatttaaatactttgaagaggaagaaaagagtggggagagagtaaagtgcctttaagaggaaaagtagaagtttttttttttttttaaagggagatctcattgtcagtggcattttaagagccttgaagctcaatgaaccaaaggaagtgtcaaacaattaagtgaggtagcaagccatgcaggcctaggggaagggcattctaagaaagacaacagcatgtgcaaagtctttggattgggaagaatgtgatttgcttaaggaatagcaaggccagtgtgtcaaaatagtgcgtcattggggaaaacagtggagaagcatgacagagaatgaaaaagagaggaaggaggtaggcaggggccagatcactggaatctacagttggcaattaatgaccatatgtactccttaagagcatgctttaatgaaactgcaaacaacagtgttgataataccaaccaatcactcaacatacaactaaaacacttcatatttttaccacagaaacagaatacgggaggtaagtatgaaaagtctgtagatctatttatacacagtgggagtatctacctgagacaagaaaaactggcacacacacacccacttgcacacacataccctttcttcaactaaagaaaggattcaggctgtaattttagcaaagtgtcttaacccaagcaacgtaactgaaaagacctagtatagtgttcaaggtgcaaatcaatcaaatgagtgtccggcaaataaatacaacagaatctatggatctagagtcagaaaattttctaaaatgtagataatatactcacaacttctttgttatctgtactgccttctactctaagagggatgctaagctcttaattatctcttcccggatttttgtgaaagcttaggaaatttaactagattgaggagggaagaaaggagtggggagagataaggtacctttaaaaagaaatcaaggaaaaagggagagatttctccagacctatgtctacagccaagatggcggattccttgactggtgaagacaggctgctgggcaccttggtcaggggtggaggaacaaaggatggcaccagaacacaagcagggagacaactccgggagtccacagaggcagccaagactgctgatgttcaggaaccaatactcaaaaggtactccagaatactgtgaaacagcccctggggagagcaagggaaaaagattcacccatagtacagattagataggatagatcagatgaaggacattaactctaagtcttaaaacttattgaattagagagacatttcttgcacactggtgtgtgtcaggtaagacccaaacagcattagtgtcaaaaaactgggaaactatacatttaacagaatagctgcaagctgtaatacattcatgtccaaagcaagacataaagttgcaagcttcacatgttcaattagggtaagatatatatgcacagaaaaatataaagccattatgggtttaaattcagtcagtcaccctgggctatttttgtccactgtacctactgttgttgggacagtcctcattccagcttaacagtgggaaaactaaatttagcccagtccaggaactggacagacaccacttgtttggcccttttcagttaaaactatgggtccagtacagttcaaattatagatattagggcttcttccccttgggaaacttgctttacagctgtggctgagaatatggccagttcattctccactaacggctagccagaagggagaggagagggaatgaatcaaattcacctttagatcacagaacaggaagtcagctagtaccaggcaccattctattaattttattgctatttcacctcaaaccaatgatacatgacggctgtttgatgtctgcaggggcccttcaccaaacaaaaccattttactttgaatggtttggcttccttggatgttttcaggtaggtaaagatactctgaagcagtgttccttttgacctggccccaagactagaatgaatgtgtgcctatccttcaactagaacaaagaaccactgctctccctcaactaacctccgccttcttggtctctgctcacgcagcagcttctctttcaattccacatcctggcttttcagaatcttttcaggttattttatgccagcacagcagaggcacttctgggaattcggcagcaagtgggccagggcataacaaagccattccagtctgactagagttaaccatgaaatgctgaatgcatggaaaaagctgtaaagaaaactaagtatttcaaaaattctatgaattctgtatatagaaaaaagagctttcaagcttaggagtaacatgaaataccaaaacaataaataggtgccaggggcagtgactcacacaacccagcacttggggaggctgaggcaggaggctcccctaaggtcaggagttcgagaccaccctgggcgacataacaagattccatcgctacaaaaaattaaaataaaaaactagctgggtgtggtggctgcgcctgtagtcctagctactctccaaaggctgaggcggaggaatgcttgagcctggaagttcaaggttgcagtgagctaggatcacgccactgcactccagcctgggtaacagtgagaccctgtctctaaagtaaaaaaaaaaaaaattaaaattaaaaaaataaattaatacctttctctctcacacacacacacacaaacaccttttatgtgttaagccagatacagttaacatgaaaaccagatgttttaaaataatacctcaaaattcagatcaaataatatatatcctgaatcttgtttaaaaagtcatatataatccactagtttcactatttttggtgctactgaataatgtatggtttgtattttttgttttatgaggttttttaatttggtttgaaatacttgctttagatttactgaaactagaattaatgggacttttttgaaattttgcttttagacctggggagtgatggttcagagtcagatgtgctcacagttatggatgctacatccactgatcctggctgaagaggttccagtgacacttgaatagtaacttttgtttcaggaggtaatccttctagttgcttaggcttcttaaacatttgatgacactgggtcttgtgctccattttctccttgaaagttaaaaactgtagccggcacttggaacactggtgtgcactctttccccagtggcccctataatgacacatgtatggtgttgctgttttgaaaattttgagacaaaagggacaaagcaaattctttgtgttttcatggcacgttctaaaatgtgtttctacatcagcaaagaccgacgatctataatggcaaacctggcacacatagggcatttcgccaggcttatgatggtccttcatgtgttgtaagaggacctgatctgtttcaaatgacaattcacagattttacagacagtagagggctcctgggcagtgtggacattttcgatgtgacactgtagctggaagggagtgggaaactgccggtggcagtgctggcaggtggtgtggttttcccagctgtcgttcctctgcttctcaaattccaaatgatgcttcacgtgattcataaacttaacattttttagaactttcacgcagctgaggcatttaaaggtggtgtgagtcttctgttccggctgcccttctcctttatgctgtccatagtaaaagtcactaagtaacacaatgggattttctttcttgggatcaaaggtcttgttttgacttgttagactcaaaatgtctgtttttgccaattcattttccctatcaagatttgtatttataggcttgaaatggatattgtcctttggaaaagctgctggaaaaggtgctccattctgaacatggcttaatgaggtatgaacattatttgagggtgtactttgctgagtattcattgtatgaaaggtatctgaagggaacgaagctgaagaatttccttctataattccatccctgagtttagcccttttgggatttatgctgtttacttcgaaagtggaaagttgctttgatacacgaggactttcatttatacctcctactgaaagtgctgtacttactggatgatgcaatgaatctgtgaatgtaatcaaaggagaaggtaattctgaagagttattaggcacaacttgtggtgaactatttctataatcaggtttagacaaaggctcaataataataggactatctgttgatctcgattcaagttgggaagctggcaggacggtcactgcttctgatgtaacggtctcatgacttttaggctgcaatttgcgagcagtatcttttctaaggtgatcatacttttttctccttgaccatgaacccggggtgactctgttcaaaatgtttgaaacgactggttttgaatttgaagtcaccccaacaaagattagctcagcatcttcatttacatgttccacaccaacaaagatgagctcagcatcttcgtcatctacttgtttggtttcttgtatgttcttctgtggttcaggctctttctcttcctcacatgattgttccattttctaatttttttattcctgaatggtggggccacaagtcccaatgcttcctttatataaactgccacctaagtacaaacatacatcagtaagtacaggaaaatgcattaccttatttaattttcctccaaaacattgtttttataaaccactattttacccacaaggacactgagactgaaagaggataaataacagcttaaaacctgtgataaaagatcaggttcctatgaatctagaatcataactttgctgtactgattgtgctctattccattttaaaaaaaaaacctaccagcagctaatcactaggcaaaattatatggaaaagacacacatttttatgagggcatcattgtgcagtgtttagaaacatgggctttggagttgaagagtaagctggaatccttagtctgccacacaccagatgcttcctctttagcaagttttttacttttaaatgtattttgctatcttaaaggcaaaaattcttatttcttagacttacagtaatagctggttttttaaaagcaccacctattcaatggcagcttgatttgtagtggaattggaagaaaattacaataaatgaaaatatctcaattgattcatatatagtaatctcataaacattaatatagaaaagaggtattaaatttatagagttagagtacctacacataaccaacaaacagcatagcacaatgtcaattgccaggcagataatctcatcccaactcatggccttaattataatccattcagtaatgcctcctaaattttcccctccagttctgacttacccactgaacttaaacacaacagtgcttcctcctcaatctcttctccacatagcaagcagattgattgtgttaaacaaagtcagactgtatcattgttcagctcaaaaccctccaacggctttctgattaactgagagtaaaagaccaagtattaccaatgcctagaagactacactaccaaccccacatactgctcctgcagttatctcatactactctccactatccacttcactgtagtcacactaacctccttgctatttattttaattttttaaattaaattttatttttttgagatggagtcccgctctatcacccaggtatatatttcagctcactgcaacctccaccttccaggttcaagtgattcttgtgcctcagcctcctgagaagctgggactacaggcatgcaccaccacacccagctaatttttgtattttcagtagagatcgggtttcaccatgttgaccaggctggtcttgaattccttatctcaggtgatccacgtgccttggcctcccaaagtgctaggattacaggggtgaggaactgcacctggccctccctgctatttcttgaacatactaagctcttttccttgctcaaagcccttgttccttccaatatgaatgatcatttgggtatccgcatggctagctcctcactgcccttagggctctattccaagtatccctctcggtgaggttcttaaatattccaaccaacctctaacccacattcctaatctcttttcccttttctttcatccccaaagccctatcaccatttaacatattacgatcctatttatcttgattattttctattgtccatccagtggaacataaaactcaaaagggcaggtattctatcttttgttgactgttgtatgcccagcacaaagaacagtgtctggcacaggacaggtgctcaacaaatacagaatttgttaaatgaatcaataaatatcgactctccttcataagatcctttatttttaaagaagattatgctccattaattccacattttctatgaatttactctgagaactttatccattggaaattccgtaggccaataaaggacttaaagctagctttttacaaatatttgaccacaaccaatagtttaaaaaaaaaaaagtgatatggagtccaattacacaagcacatacacataaataataactacctttactacacaggctgcattctaaaattttctatttcatttttcttgtctttttcttttttttttttttttgagacggagtctagctctgtcgcccaggctggaatacagtggcgcaatctcagctcacggcaacctctgcctcccgggttcaagcaagtctcctgactcagcctccagggtagctgggattacaggcacatgccaccacacccagctaatttttgtattttttagtagagacggagtttcactgtgttggccaggctggtcttgaactcctgaccttgtgattcaccagcctcggcctcccaaagtgctgggattacaagcatgagccatggattacaagcctgagctgtgcccagcctcatttttcttaaactaaccacagacccacaaaatcagttaagcctcatcactaggtcactactagttgtttcaaaaactggtctaatgctagcaaaatgtacgcactagaaaccaaggttcataactcaccaatttctaaaaacatatcaagattcactgtatccccatgtggacccttcaaatcagcataatccaaagcataaaaattaaattgacatctaataaatgccatgcacatttgttttaattttaattaggatatcagtatctaattttggaacatatagacaatatttattcctataaatatgtgtatcaccttggaagtgaatttaaaaaggaatacaatattaagtaagcattgtcaactatatacaaactggtgtatcatgaatagtgatttacaacttaattagtagatatataatgccagaaaaaatataaggcagatatgaatacactgctctctggagtcaactaaaattggtttagtctgtctatatacaacttcaatcgcctaactccaggatgatgtcacctagcccagtgtttcctaagcattactgacatttgggactagataattctttgctgggggctgtcgagagcactgtaggatgtttagcagcatctgtgatctctacccactagaaaccagcagtagtcccccagggtggcaactaaaaatggctccaggaattaccaaatgtcctgtgggaaaactcctgcccaaatccaatcttctcaggatcacttccacatttccagtaactaccttctacataattctaaatgtattttctaacatcctctctaaagaaaatatctggccgggcacggtggctcatgcctgtaatctcagcactttgggaggccaaggcagttggatcacaaggttaggaattggagaccagcctggccaacatagtgaaaccctgtctctactaaaaatacaaaaaattagctgggcctggtggtggacacctgtaatcccagctacttgggaggctgaggcaggagaatcgcttgaatccaggaggcggaggttgcagtaagccaagaccacgtcactgcactccagcccgggtgacagtgcgagactgcatctcaaaaaaaaaaaagaaaatattctaattcacaatcattaatattctccaatatcctaaaaaatcagactataatctgacaacatggccattagatttatctgaagattaattagtttattattgttattattttttctttttcaagacggagtcttgctttgtcacccaggctgaagtgcagtggcatgatctcggctcactgcaacctctgcttcccaggttcaagttattctcctgcctcagcctcccgtgtagctgggattacaggtgcgccaccacgcccagctaatttttgtatttttagtagagacggggtttcaccatgatggccaggatggtcttcatctcctgacctcatggtctgcctgccttggcctcccaaagtgctgggattacaggcgtaagccaccatgcccggccaatctgaagattaatttttaaagcccccagaagtttatgatttactaaagttatatggagggtttgtagacagagttagcactaagatgcctaattcctgaattctggttttgtgctctttctgctaaaactgacttagtgcacacttatttctgatgatattgctgttaactgcttagtctttaagaattaaagtgtctcattggattcattttttcactctctattttgtaaacctgttcaaacctcctctacctcccagaaaatgtcaaagtaccttataagccattttaaataacttttagagcatcactcattctacctctcatgtccattcctattaatggcccccagcccaggccgcaacttctaggtttaggtccactggttacttcatttttgtacacttgtactagaccctaaattgttctgtctcttttctctgtccttcaaattatataacacaacaccacaagatggatcttaaaacacaactgtaattatatcactcttctatccctaagcgttaaatgattcctccaattctagagaatattttaggtatacataatttgtgttatgctatgggctgaactgtgttccccccacccccaaatttgtatactgaagctataacccccaatgtgatggtatatagagatggtggctttgggtaataatcaggttaagatgtattcatgaggatagggccctcatgatgtgattggcgcccttataagaggagatatcacagaccttgcttcctctttctgtcatgtgagaacacagcaagaaggctgtcatccaccagccaggaagagagccttcactaaggaaccaaatcgtccagcatcttgatcttgaacttcccagcctaaaaatgtgagaaatgaattcctgttattaataaaccatcaaacaagtaaagaagaaaaacttaaactgggttctaatgacactgctggacttcctaaccagttgctcttggttagatttttggctgttgtccatactgattaaccctccatccaaccatcaatcaaggtgaaaaagaggaatagagcaaggatcaggaacaaagctaataagttaatgaacaagttcattaagaacaagagtagcattagaccatgagagttttcttctcctctagatgtccagagacccttctctacaaatgtccaccaatggatgaatgaatgcttattttccaatttgccagaatcttgagatactggggtagggaggttagacatgcaaagatatatcagatctaacaggtttgtcctcaaaaatcaattctcacctcccatgatgggagaagccaataggagggcttcaattccaaagaaagctgagagatcagtggatgataacccaccttccagattatttctatgcattcaaacaatggcccttctactagatcattgttttttgttttttttgagatggagtcttgctctgtcacccaggctggaatgcagtggcgcaatctcggcccactgcaatctctgcctcccgggttcaagcagttttcctgcctgaggagctgggattacaggtgcgtgccaccacgcctggctaatttttgtatttttagtagagatggggtttcaccatgttggccaggctggtctcaaactcctgaccttgtgatctgcctgcgtcggcctcccaaagtgctgggattacaggcgtgagccaccgtgcccagcctctagtaaaccattgttattaccacacacgagtttttaaccacacacatactcttctgaggaaaggcttccccaaactattggtccttatgatgagatctggccatatatatttttcttctgaaccccaggattgtggggctgtcacatttcctctaacagtacaccttaggagctcccagacttgaagaaaattggctgtttcccacatttgaacattttccactttttccctcagtctacctttttgaattgatttctgactacttctagataacctttttccattaatgaatattgagtgcttattgtgtgccaggcactgctttaggcacttgagagaaatcggtaaacattaacagacagaaatgaacaacaaaaacaaactatttcaacagaaggaactaacaaacagtccagtggaggaagaaagatagtaagtataataaaaatgcaaattctctggtgaactggaagatgacgttatagaattaggaaaaaaataatagagcaggcttagaagttgaggaggtataagagaattgtaattttacgtagtgtagtcagagtaagtctcatggagaaggtaaatttggacatacacttgaaggggataaaaggtcagagaggtagcaagagtggaaatagtagtaaggatctgtaaattcttcatttttctctcagtttagtctgtggcaactgtcatgtcttttgataaggaacgaccttggtttaatagttactcccctcctagactctcaggctagattttttttttttttaattgagacggagtcttgctcttgttgcccaggctggagtgcagtggcacagtcttgtgcacagtcttggctcactgcaaactctgcctcccaggttcaattgattctcttgcctcagcctaccaagtagctgggattacaggcgcccaccaccatgcctggcgaatttttgtatttttagtagagatggagtttcaccatgttggccaggctggtctcgaacccctgacctcaggttatccacccacctcggcctcccaaaatgctgagattacaggcgtgagccactgcgcctggccttttttttttttttttttttaagatggagtctcgctgtgtcacccaggatggagtgcagtggcacaatctcaactcactgcaacttctcctgagatgcttgtgcctcagcctcctgagcagctgggactataggtgtgcgccaccatgcctggttaattttttgtatttttattagagatggggtttccccatgttgtccacactggtctcgaactcctgacctcaagtgatccacccaccttggcctccaaaagtgccgggattacaggcgtgagccactgcacctggcctctcaggctagtttcaaccctattttacactcctctaccatcctcagcttacttttgaaaaagtatttattaaaaaatatttatgaaaaagttatttttgttttatttagttgccctgggatggaatacaaatgtttgctgtagttttaaggatcctataaaactcccatttactgcaaggatctctgtttaatgggcattcaattctaagatagcaaacgtgtagagttatttgtgggggtgggggacaagtttgagaaagaagcagtggggtgaagaaagtgataggcaagggaagatggtggggataggtaccataggagtcctggtggcctaaaatctaatcacagaagttactcaagtgggactgatgcctgaaaaaaatttgtgtgtggctataacagtgagtgggatctactcttttttttttttttttgagatgggagtctcgctctgtcacccaggctggagtgcagtgccgtgatctcggctcactgcaacctccacctcctgggttcaagcaattctcctgtcttggcctcccaagtagctgggactacaggcacatgctaccacgcccatctaatttttgtatttttagtagcgacggggtttgatcatattggtcatgctgctctcaaactcctaacctcaggtgatagacccgccttaggctcccaaagtactggaattacaggcgtgaggcaccgtgcccagcctgggatctactcttaagcaacagagaaaatcagtcatttttccccttttccttcccttcctcctatgagcagaatcttggtctccatctttaaaaaaaaaaaaaaaaaaaaaaaaaggccaggcacagtggctcacacctgtaatcccagcactttgggaggccgaggtaggcagataacctgaggtcaggagttcgagaccagcctgaccaacatggtgaaactccatctctactaaaaacacaaaaatttgccgggagtggtggtgggcgcctgtaatcccagctacttggtaggctgaggcaagagaatcaattgaacccgggaggcggaggttacaaaggagatttgacagggtggcagttcaaactaaaagtggtctgatagttcagagtcaagtttcttcactaaagctgagtttttaaagggcttgaagaatgatgtaaagaggggttgtggaggaccacaaaaaaagacaactaaaaaaaggcataacaaagtcaacttattaaatgcccagcaacagggtgaagttaaggggaatggtggaataaagacctacaaatagctgctgcttcataaaagcaaagagaacactagcaaaaactacaaaaatcacgtttttcagatcctggaaattaacgaaagcttgtaaaactcaaaagattttattacaaaatggcttggcggttcctcaaaatgttaaacatagacttatgatcccacaaatctaagtatacactcaaagaaataaaggtactcaagtacatgtatacatgtttatagcaacaactcataataatcaaaaggtggaaacaacctaaatgtccatcaatggatgaatggataaacaaaccatggtatatacatacaacagaatgtttattcagccataaaagaaacgacatactgatacatgctacaacagggtaaaccctgaaaatataccatgtaaaagaagtcagtgacaaaagctcatatattgtatgatttcatttacaggaaatatcagaaatagataaatccatagatattaaacaaagatttgtggttgccagaagataggaaagggaaaatggtgagaaactgcttaatgggtaaaggggttttactttggaatgatggaaatgtatcagaactagatagaggcagcacacgtacaatattacaaatgcactaaatatcactaaactgtttattttaaaatgactgatgttatgtgactttcacctcaatgaattattttttaaaaataaagagggtatattactaccaaccacacagaaaaaaagagaattataaaggaatactatgaaaaattatctgtcaacaaattagataacctagatgaaacaaattcctagaaagacaggaactaatgaactgactcaagaacaaacagaaaatatgaatggatccaaaacaagcaatagaattagtaatcaaaaaacttccccaaataaaagcccaaaatcagatagctatgctagtaaattcttaacgtttttaaaagaattaacaccaatccttcattaactcttccaaaaattagaagaggagagaaaactttgcacatctttctatgaggctagttattactcttacaccaaaatcaaaccaagaaatcatatataaaaaaagaaaactacaggccaatatcctttttttttttttttttttttttttttttggagacggggtctcgctctgtcgcccaggctggagtgcagtggcgtgatctcggctcactacaagctccgcctcccaggttcaggccattctcctgcctcagcctcccgagtagctgggactacaggagcccgccatcacgcccagctaatttttttgtattttttagtggagacggggtttcactgttttagccaggatggtctcaatctcctgacctcgtgatctgctcgccttggcctcccaaagtgctgggattacaggcgtgagccactgtgcccagccaatatcccttacagaggcaaaaatcctcaacaaaatgttagcaaacaaaatctaacaacatatataacgattacataccatgaccaagtgggatttatttaaaaaatacaaggatggttcattctatgaaaatcaaccaacaataattttatttttattatttttaattttaattttttttttgagtcggaatttcattcttgttgcccaggctggagtgaaatggcacgatcttggctgaccacaacctccgcctcccgggttcaagcaattctcctgcctctgcctcccaagtaggtgggattacaggcatgcgtcaccacgcccagctaatttgtttgtatttttagtagagacatggtttctccatgctggtcaggctggtctcgaactcccgacctcaggtgatccgcctgccttggcctcccaaagtgctgggattacaggcgtgagccaccatgcccagcctataccattttaataaaggacaaaaactacacctgcctgcagaaaaaacacttgacaaaagctaacatccttttatgatttgaaacaacaaaacgattaggaatagaaggaaactttctccaccagacaaaggcatctgtatgagactcacagctattatagtatcatacttaatggtgacactgaaagtacccctgcccctaagatcaggaacaagacagatatccactttaaccacttcaactcaacaccgtactagaggttctatagccaaggtaattaggcaagaaaaggaagcaaaaagcattcagattggaaagcaagaagtaaaaccataatggagatgacaaatacaaataactcaattttttaaaaggccaaagaacttgaatagacatttctccaaagatgatacacaaaagaccaagtaaatatattcagtgtcattaatcataaaagcaatgcacattaaaaccaccttgagataccacctcacacctagtaggatgactactattaaaaaacaaacattgttggaaagaaattagaatcctcatgcacagtcactggattgtaaaatggtataactactatggaaaacagtacagaaatgcctcataaaattaaaaacagaactactatatgttctagcaatcttacttctgggtatatatctaaaataattgaaagcagggtctcgaagagatactggcacacccatgttcacagaaggactattaaaatagccaaggggtagaagcaacccaaatgtctacccaaaaatgaataaacaaaatattatatatatatatgcacacacacacaatagaatattattcaacctcaaaaaggaagaaaatctgtcacatgctacatgtttgaaccttgaggatattatgccaaataaaataaaccagtcacaaaaagacaaatacttttgtatttgtataattccacctatatgaggtaactaaaatagtcaaattcatagaaacagaaagtagaggccggaagcagtggctcacacctgtaatcccaggactttgggaggctgaggtgggcagatcatctgaggtcaggagttcgagatcagcttggccaacatggcaaaaccctgtctctactaaaaaaaatacaaaaattagccagatgtggtggcaggcacctataaacccagctacttgggaggctgaggcaggagaattgcttgaacccaggaggcggaggttgcagtgagctaagatcacgccactgcactccagcctaggcgacaagagagaaactctgtttcaaaaaaaattagctgggcgtagtggtggcacacacctgtagtcccagctactcgggaagctgaggcagaagaatcccctgaatctgggaggcagaagttgcagtgagtggagatcgcaccactgcactccagcctgggcaacacaccaagactccgtctcaaaaaaaaaaaaaacaaaaaacaaaaaacaaaaaaccaaaaaaacaaaaaacagaaggtagagtaatggttaccaagggctaggggcagaggaaaagggtgagtctgttgtttaatgggcattgtttcagttctgcaagatgaaaaagttctagagatctgtttcacatcaatgcttgaaactactgaactattaatttagaaatggttaaggtggtaaattatatgcgtttttaccacaataaaacaattcattttaaaaacaggccccaatcggcatggtggctcacgtctataatcccagcactctgggaggccaaggtgggagaatcacttacagtcaggagtttgagaccagcctggccaacatagcaaaaccctgtctctactaaaaatacaaaaattagccggcatggtggcacgcgcctgtaatcgcagctactcgagaggctgaggcaggaagaatcacttgaatccaggaggcagaggttacagtgagccgagatcatgccaccacactccagcctgggcgacagagtgagactctgttaaaaaaataaaataaaataaaaaataaaaaataagctagacacagtggctcacgcctgtaatcccaacactttggaaggctgagatgggaggatcgcttgagcccaagagttgaagatcagtccaagcaatgtagtgagaccccttctctacaaaaaatttaaaaacacaggcacagtggctcatacctgtaatcccagtattttgggaggctgaggcaggaggacttagtcagctcaggaattccagaccagcttgtacaacatagtgagaccctacctctacaaaaaattaaaaaattaaccgggcgtggtagagtgtgcccgtgatcacatcactgcactacaaccttggtgccagagcaagactgtctcaagaaaaaaaaaaaatttaaatttagctgggcatcatggcacacgcctgtagtcccagctactcaggggtggaatgaggcagggtggcagctgagatgggaggatcactggagcctgggaggtcgatgttgcagtgggccataattgtgtcactgtactgcagcctgggcaacagagcgagaccctgtctcaaaaacaaacaataaaaaatgggcgaaggatttgaacacttctccaaagatacacaaatggccaagcagcacatgaaatgctgctcaatatagtcattaaggaaatgcaaatcaaaatcacaatgagctattacttcacatccactaggttagttataagcaaaaacaatctcaagcgttgcagaggatgtgcagctatctgaaccctcaaatactgctggtgataatataaacttgtactttggaaaagtttggcaattgctcaaaatttaaatatggcgttaccatatgacccaacaatatcactcctaggtatatacccaagagaattgaaaatataacacatatataagctagctggaatatagccataatgctgctacaaagtgcaaacaaccgaatgtaaattaattgataaatgaataaacgaactgtggtatatccgtacaatgaaatactattcagccataaaaaaactaagtacaaacaagcatacaatacggtgtaccttgaaaatacactaagtgaataacaccagacacaaaaggccgcatattttattattttacttatacaaaatgtccagaataaggcaaattcatacagacagaaataaagtagcagctgccatgggctcgatgaagaagaatgaaaggaatatagcaggtttgaaaaatggcccccaaaatatcaggtcctaatcccttaagcctgtaaatgataccttatttggaaaaaggatctttgcagatgggaaaattatcctggactatacaggtgggccctaaatgccaccacaaatgtccttgtaagagaagcagagggagatttcacacatactctaggaaaaggtgatgtgaagacagaagcaaagattagagtgacatggtcacaagccaaagaacgtcacatccacaaactagaagatgcaaagaatggattctccgctagagtttcccaggggaggacagccctgccaacatcttgatttaggtcttgtgaaacttattttagacttctgacctcccgaactaagggagaataaatttttgttgttttatgccaccaagtttgtgataatttgttatagcagctatggaaaagtaatatagggagtgactgctaatggatacaaggtttctttagagttgatgaaatgtcttggaattagatattgctgatggttgtacaattttgtaagtatataatactaaaaaccattcaatttcacaccgcaaagggtgaattttatggcatatgaactatatttcaaagaaaaacaaatgcctagtaacaggctggtataacccgccatctcccaacaactgctgctaaattttcaaagcaccattaagcagactcaattcgtagcaaggataatggaacaatgcaagctcatctagcgaacaaaaagaattaagctagtatcaggtggtcaatttacaaactgtagtgggagtcatacattcccaaggatggaacagttatatctccttgcagagtgaactcttctccgataccaaggacttggaagaccaaataaattatacgtaggattaccaaatatgctggtatgaccaagacagttatagtttaaacttctatctctgtggaattatggatagtgccactcttcaatctttaataagtccttcagtttagatgataaattacatagtcaacctagttataaggaatctagaggttgtgaaaagctgtgagagcatattctatgcagaccacataggtcctatcatgactccctatgtaacttgggtctctgcgactgggaagctcccagggaaaaaaccccagttaagacttctgcagagcattcacattttgtttcaaacttatacaacactaatgctaaagctcaactctcagaattgtattattcagtattatccaaataactgattaatttacacactgaagggaaagaacaaggaatggacctatacacacttgtagtttacaagtataagaagctaacaaagaataagattaaaataacttgtgccaggccgggcatggtggctcacgcctgtaatcccagcactttgggaggctgaggcaggtggctcacgaggccaggagtttcagaccagcctgaacaacatggtgaaaccccatctctactaaaaatacaaaaacttagctgagcgtggtggcacacgcctgtaatcccagctactcaggaggcaggagaattgcttgaacccgggaggcagaggttgcagtgagctgagattgtgccactgcactccggcctggacaacacagcaagactccgtctgaaaaaaaaaaaaaaaaaaaaacaaacaacttgtgcccacattaactaggtgttaaaagccaaaaggtgaaagtcactattctcttttcacatatcaaattgaccctaaggtaatattgctgcattagaactgagctggtgggagggatgttaagaaattagggagaaattgttaatctacagaaagaccatcatataaggttctgtgtgtagccaaacatacacatttgatgttctgatgtttgctattttagtggaactatagctataaaatgtattcaatcagtagaattaaaacatatcccagtccacaaaaaactaagagagaaattatacaggaatgatcaagaatctgcacagttctcataatctcattactagagagaaaaggagaaagggaagcatcaaggtagtatttgagacgaatttaagaagaccactcattcaataaaagtttggtgggccaacaaggtgccatgtattggtctggtgatatagcagtgatccaaagtctttcacttcagggagctgacattccagaaggagtagtcagaaaataatttttttaacaaaagtaacatggttatataaacactagggagaaaaataaagtaggaaatggaggcaggttgatactcacataacatgaatatggctgtctggggaagaatactccaacaaagggaacagcaaacacaaagcctctgagactggagcacttaacacatgcaaggactgatcaataggctaacacaggtggaccaatgaaaagagtgacaagttagaaatgagataaaaaatgagctgtttgtggcaaaggaaagccaagatcatgtaggccattctaaattcttcagctttggccaggtgtggtggctcacatctgtaatcccaacactttgggaggccgaggcgggtggatcacctgaggtcagaagttcgagaccggcctggccaacatggtgaaaccccatctctactaaaaatacaaaacgtagccaagtgtgctggcatgtgcctgtagtcccagctactcgggaggctgaggcaggagaattgcttgaacccagaagacagaggctgcggtgtgctgagatcatgccactgcactccagcctgggtggcagagcaagactccatctcaaaaaaataaataaaaataaaaataaaaataaaataataataatacaaaaattagctgggtgtggtggcgggcacctgtaatcccagctacttgggaggctgaggaggagaatcacttgaacccaggaagcagaggttgcagtgagccgagactgcgccattgcactccagcctgggtgacagagcgaaactccatctcaaaaaataagtacataaatagacaaaaaataaaaacaaattcttcagcttttaccctgagtgtgatgagagattactggaaggctctgagtgagaagtaatatgatctcactcatttcattaggattgctgtggttactgtgtggagaatagactttagagagtaatagtggaagcagaagacaagaagctactgaaatattataaacaaaagatgatggtagtatcagacaggatggagaaatagagatactaagaagtcggactctagataaaaatctagaaggcccaattcattgatggattgggtttgggatgtgaaggagaggaggaggacacacaagaggtaatgctgagcaggtaaatctatgagatcagagcccaaggaaagttccgaggtaggtacttaaattttgaagtcttcagtatgtagcattatttaaaacacaagactggatgagatcactcagggaaaagaggtctgagatctaagctctggggcattccattgattagaggtcatggagatgagaaggagctggtaaaggaaattaaaaaaaaaacaattattcacagccattcaggtgggaggagaattgagaaagagaagcatcccagaatccaatggggaggagaaaaggaactgtaatatatgctgccaatagatcaaataaaatcacgaaaatcaactaaaactgaccaatggattaagcaaagtggaattcattggtgaccttgacagcagtgggtttaaggaagaacgagaacaggagatagcaaatacggacaactctggagaaattttcctgtaaggacaagcaaatacaaattaaaacaagcagatgggagatgtggcatcaaaaacgagatctttaaggtgaggtgatggtacaatcagtatgtttgctatattaatgatctggagagatagaaaacttaaccctagacaaagagaagtcttgctagaataatatccttaaataaacaagtgcacatgtagaggttctggccttagcaagaagtcaaattattcacccagagtaacaggacaatgctttgagatcctatggaaaagggttaaatggtggataaatggttgcggtggccatcctccaagatggccctaaatgaatcccacttcctggaattcacatagttgtagccctctcccactaacagggttggcctgtgggatcaagcacatacagcaggaagtgatggtatgccacttcagaaattaggtcataaagactctgcccttcatcttgggtacaaggtctcttgaatcatttgctctgaagtaagccagctgctgtgacatgaacagccccatggagaggcccacagagcaaggaactgaggcctcttgccaacagcccagtgagtgagcttagaggcagatgatccaaaccaagtcaattccgcagagactgacaatccagccaaaggtttcactgaaacctcatgagtgaccttgagccagaaacagccagctaagccactcttggattccagaccttcaaaaactatgaggtaataaatttttttttaaactactaagttttgagacaatttgttacacggcaatagataactaatacaatgggtctcactgagctgtaatcacaaattgctgggcacacaattcactataatctcacctactggcatgcaatgacttcagatgacctcccctgtcctgctgcatgcagttacctcatgaaatacagtcgctgagaaagagggtaggataaaaggagtcagctttatataacttaacatccctgatgctcttttttttttttcaagagatgtggtaaaagaatgccactaccaccctctcctttctcaacaaagcaatttagagggttcccgaatgacctacatcaacaattggcctgaactaatcaaacgcatcattcagattccctcagtaaaatattgaataccaaacagctatgcttcagcaaaggaaagggcaagggagcgaaactgaaggacgaaaatacaactttggtcctcatcagggagacttctcttttcttacctcaggtttattacaacgcaacttttaagaacttgagctattccaggcagaaggtcacatccttgaggtaaccagagagaagcattagttacttacatgtcacaagaatattttcgatcccactgcctgacattgccatttaggtgtttatcaatcatctcacacttaaccagataagtgaactgaactcctttcccccagatctgttcctccaatctaccctaccttagcaaaggaaaacgtcccacccgccaactgcccaaatcaaaagcctgcaaatcacccgaggtcctggctctcacgggagggactccattagggtcccaggggctgcattaagagtcccgacagcgacgcagtaaatgagacaagacgctgcggtaggggagagagacccatacattcaaatgccttaaggggtctgggcctacaggtctccagaactggggagggcctggggttacaaagcagttttcagatttttaaatacattgagcgccaaaagagaccccgcgggggcgatgggggaggggagcgcactgggagccaggaaaggccccttctccaggaggcccgggcccagcccgggggtgggggcgtctgcgtgagggagtggaggctgatgtaaaagtggcgcccgctgagattagggaagggggtgtgcgtgaggggatcgtgggacctggttctgccctgcactcccccacagaaagcggctgtattgcaaaggccgctccggcagcgcacggccaagcgcggtgtcgcgacccgcagggctgcggctcgccatgaaatccctcaagtctcccctcagggaacgctgaagccgcgccacgcccccgtccttaccagtccggatcagctgctgttcgcgagctgccggccacgcaccagccccggaggcgctcccggggcacagccggcggcgactacgcctcctcaggcccccggcgccgccgacgcgcacgcctccacacgcgcgcgtccagtggagacctgcgattggctgccaggtgccggcgcgagatcggcgcggctccgagctaggagcatgcgcgcgctctgacgcccctggtggcgacggctggacgcggggttaaattgagaaggaggagggcagcagcaatacccctgaggccttgaaaggatcttgggttccggatcacggttccaggcagtcagggttccagagctgagggggtatccaagcagtcagggttccagagctgaggagcatccaggcagtcagggttccagagctgaggggcacccaggcagtcagggttccagagctgtcgcagccagggcttggggtggggggtaggcttccagtccatcaggggatggtttgcccaccagaaggccagctgttataattctcaggtgtggtccctttgttgactatccatgcttaagggattgtgaggaaacaactgaacctaacatctgtcctcttctagttacatctggggccagttgaatccagcctgccacctgtttttgtacagctggcagcaagctaagaaccgatttcacgtttttttaatggctaaaaagagaatattttgtggcatgtgaaaattatatgaaattcaaaattcagtgtccataaataaagttttattggaacaacaaacatgcccattcctttcggtattatttatgcctgttttcctgcttcaacagcaaagttgattaattgccagagaccatgtatgaaaagcttaaaatatttactgtctggccctttacagaaagtttgcccactcagtttacttgcagctttgattttttttttgaattgaccaattctgccaaaagtctattttagcaatctttttggggggcgggtaaatcgcttttggtttaattaatctataatgttattttcttatctattttatctatttcttccattctgttattttcttccttcgtgacttcataggcttgttctgttacttctcattacaacttttggagaaaaatgcctacctcgtttgcttgtaaacttttttgtttctcttgtatttaatgctataaatttacctttaagtaccagtttaactgtgtctcaccagtccgcttggtaatatgttcattatccttcaattagatatgtcctaattttgctagttgttagaaatgcttgttccctggtgccgcaaagaaatagcacttgaacataaatttaattttctcagcaaggccattttcactttctgcagaaagggtacactcgccagcagttttgccacgagagtaccccaaacaaaggatacagggttatttataacctgacgcatccaccctactgctgtgtccggtttccattggctggaacaggacctcacattctgtgtttgtcccgattggctaacaacttagaactttctaaaagaggcaaaggcagaggagaacaaaggaaggaggatgtaacttgtagaatgctgagaaaggtaaaaacacctccaaataggaagaggaacaggctatgacctaatgcttgcttggaccagtataagcatgcaagggcaaatatttaggctaaattgtgggagctaagaacacaaagtatattaatttctttattacggctagcagatatctaagaatgttagcacaggtctttgaataaattttacttctaagagaagttactatttattcgtaattagacagggaggaaagtctttgaagaggaacctctactttattttttacatagtgattctttctaacacaagggttatatagtatatgttatttatttttgaaatctatgagatttttaaaagattttttaattgtattataatcaaatcacatggcctaaatattactcacccttgcatttgaagatttctgttcagtgaagtgtaccatagtcaaaatgaagagatcatagatgtaaagaagatatttgcagtatctaaaatgtatatatgaggctgatatgtaaagatatttgcattatctaaaatgtatatatgaggctgatatgtaaagaagatatttgcaatatctaaaatgtacgtaagaggcctggcacggtggctcacacctgtaatcccagcatttttggagaccaaggcaggcagatcacttgaggtcaggagttcaagaccagcctggccaacatggtgaaaccccatttttgtacaaaaaatacaaaaattagctgggtgtggtggcacgcgcctgtagtcctagctactcgggaggctgaggcatgagaactgtttgaacctgggaggcagaggttgcagtgagctgagattgcaccactgtactccagccttgggcaacagagcgagactccgtctcaaaaaataataacatgaaaaataaatctatgagaaatgatcttcttttggcttcataataattccaatgtccatcagtaaattagtatcaactaagctccaggctttattcaaatgtcactagtttttcccatcatcctttttgttccagattcccacccaggatactgaattgtacttggtcattttgtgttcttagccttctgtggtctgtgacagtttcttaaacttttcttgcttttcatgaccttgacaattttaagaagtaaaggtcaggtatttttcagagtgtctctcaatttaggtttgatgtttttctcatggttacactggggttatggtttttagaagactatcacagacatgatgtgtctttctcataatttctcatcagcgatccatgctatcaataagacttcctactggcttctccgctgtaaattacttcccccccctttcataccttattctaaatcttgcctacatgcaggaaggccgtgaggtctcattgaaggaaaattatctacacaagttactttgcaattcttctttaaggaagatttgtctcttcttcctttagttttaaattaatcaaaaatagctttttagttttaaattaatcaaaaataaaataaaaaatttagtacctcagtcatacttgccacatttcaacagatcaatagtcacctgtagcatattggacagagcagaagtagagcattttcatcattgcagaaagatctacggacagcactgacttagatcattagtcaacctttcttcttcccaaatatatgcatttagaaatataaattcccatgaaatgctttagttccatcccataaattttgtggctgttttcaatatctttcagttcaacattttccttttttcactgcaatttcttagaggagctatgggttattcagaatgaggaccaggactggggtgagataagcaaggaggctgaggcacattaaggagagacccacgcccagcttcaggtatggcatattgtcaccttaggttccctgcttgcctcaccctagtcccagccctgtttagaaatgtattgcctaatttaggaactttgggttttttttcagtgatctttctgttactgatttgtaagttgattcccgtgtactcagtgggtaactacaaagagccccacagctaacatcacaattaaagtaaactattctacctgagtttgagaccaagaaaagcacacccatgaaagccacttcaattcgcaaagcatttggaatagccaaggcaattttgaacaccaaagttggagaaatgaaactaccacatggaggattatgcaaagctacaataattaagatactgcagcattagcacaaggatagagaacaggacaaatgaaatgaaatagattccagaaacacatatatacaatcatacctgattcacacagtttccacggcaatacagtagggaaggagtggtctttttagtaagtggtgctgattgattttgggtatgtatatgaaaaaattagtcttcatgccttatcacaccattaacaaaaaatcagtttgagatgtctcatcaaaacagtaaagcttctagaacatagaaggaatatctttatgtcgtttgtagacaatttcttaaataagactcatgaaagataaaccataaaaccacgatttagatccaaatatgggacatttccagtgccccagcacccttcccagtcgacagcccagtttttaaaaaggtaggagggggcaaaacttgaatagacatttaataaaaagaaatactcacgtggccgataactatataatctcaaggtccattaatcctcagggaaatgcaaattaaagccacaataaggtaccactacaatttcaagagaagggcacttactaaaaggactgacagtaccaagtgctggatcagtagcagtggaattcgcagtatcggtggtgggaatgtaaatcgtttcaatcactctggaaatgtatttggcagtatctacactagacagctaaatatatgcagttccagcacttctcatagctatatacacccacgagaaatgattacatgcttaccaaaagacacgcacaagctcatagcagctttattcaaaattgccaaagaatcagcctcaaagtccatcaacagtgaaataaatttatacaaaactgccacagtcactcaacaaaattctacccagcaatgaaaaagaatgtgctactgctacacacagcgaaaatgcatctcacttattttatttcattttactttattttgagacagtcatgctctgtcacccaggctggagggcagtggcgcgatctcagctcagtgcaaactccccctcccaggttcaagcgattctcctgcctcagcctcccgagtagctgggactacaggcgcccaccaccacgcttggctaatttttctattttatgcagagaaggggtttcactatgttggccagcctggtctcaaacttctgacgccaagtgatccacccacctcagtctcccaaagtgctgggattacaggcatgagccatcacgcccagccatctcacttattttaaaaagccaaagacaagaatctttgtgtgattccatttatttaaagttcataaacaagaaaaacctctgaggtcagaataagggatgccttgttgggagcatttgactgggaaagggctcaaagactttggagctacttcttgacaatagggagctgatgagatgtcactgtgaaaaacaacctgacagttgatgacattgcttgctagcatctacagccacaatgcacatatggcctagcctcacttctgcctttcggaactcctggaagtcagtcgaacatattttcagctagaatccttgctgcaagggagtctggaatctctagtgttcatagccgtcttctttttagtttttacaggagaagactgagggtcagtgttgctaacaataacggaagccataccacttgatcctggctgaactgaagtttgaataataacttttgtttcacgagggaacccttgcagttgctccggctttttaaatgtttgatggtccttggttttgtgctctatttcctccttcaacgtcaaaaactgtagccggcacttggaacactgaaggaccctccttctgctgtgcctccaacaatgattcatgtatggtattgcagttttgaaaagtttgagacaaaacagacaaagcaaattctttgtgttttcatggcacgttctaaaatgtgtttccacatcagcaaagaccgacgatctgtaatggcaaacctggcacacgtagggcatttcgccaggcttatgatggtccttcatgtgttgtaagaggacctgatctgtttcaaatgacaattcacagattttacagacagcagagggccccatggcgatgtgtacactatcaatgtgacactgtagctggaagggagtgggaaactgccggtggcagtgctggcaggtggtgtggtcttcccagctgtcgttcctctgcttctcaaattccaaatgatgcttcatgtgattcataaacttaatattttttagaactttcacgcagctgaggcatttaaaggtggtgtgagtcttctgttccggctgcccatctcctttatgctgtccatagtaaaagttgctaagtaacacgatgggattttctttcttgggatcaaaggtcttgttttgacttgctagacttgaaatgtctgtcattgccaggccagactcatttgctctctctggatctgtaagattgaaatgtgcctttccattagcatcaggccaaggaaatgttactccattctgaacatggtttgatgagttgcagatcccctgtgagggtgtatttgtgcttattgtagaagacatatctgaagggaccacagctaaagaaggtacccctgggattccatccctgagtttaacccttttggaatctctgctgtttatatctgaagtggaaagtcgctttgaatcaggagaactctcatttctgcctcctccagagaccatagctccaactagacactgagtccctggggggagcgaatctgagtaattgggagaaacaacttgtggtgagctcattttataaccaggttcagatgaagacttcatagtgacaggactatctgtcgatcgcccctcagacagagaaacgggcatgatggcttttgccatagaggtcacatgatttgcaggctgcgacacgtgagcaggatattgacggaagtggcctttctttcttcttgactttgagcctggggtgactctgttcaaaatgtttgaaacgactggttttgaatttgaaatcatcccgacaaagagaacttcagcatctctatgtacatgctccaccccaacatagatcagatctggatcttcatcatcctcctccctttgtttggattctctcaaattcttctttggtgattccactttcttacacaaaaagatatctcccattttcaatttactttttgcttgaagccactggtctcttcaacttccagagctgtctttttacaaattgccacctaagtgcaaccatgtgacaatagtcaatatttatttcgaaagacaaaatcattactttattgtatcctcccttaaaacactgagataaccatcaacatctctattttacacgtcagaaatgaggcttgaaacattttaaatggcataataatttcaaatttacctgtctctcctcccctggtcttctgcagttgtgaggcaaaggaagcaagatttcaggaggtgcagatggaacatctcagagtgcttgcctctaaattttgcactctagatgcctcactcacctcctcctcatcccacaggtactctctcagatgtctaaggtttctaaccaacttgaacaaaacttctctcaaaaacattctgctcctagcctgggcaacatagcaagaccccatctctacaaaaaaatttaaaaattaaaaaaaattagcttggcatggtggtacacacctgtggtcccagctacttgggaggctgagccaagaggaacacttgagcccaggacttcaaagttatgttcatgccactgcactccagcctgggcaaccaaatgagaccccatcacacaaacacacacacacacaaatcacaacacacacacacacacacacacacacacacaccctttgctgttcctgtaatgttccttttctcagtaaactcagttgctcagtctacaaacttcagagtcatcctttgccagactttctctcatacactacagccaatcaattagcaaagctagtctgctctatcttttaaagatatccagaatctgactactctcttccacatctactgccacctccctgatggaaggtaccatgttctctccctggatcactgcagaagttgccagtcttaaaagttttgtcagatctccccatggtggccccaatgcccctgttaaaatatacaggggagcaagtatattttgctcttaagtcttcaatgactttccatttcattcataggaaataccagcaaactttaaatttctccatggaaccttaggtcatcatcgcccttgctaactcctctgttgctctgatgcagccatcctgagctccgtgaatctggaacacaccaggcctttttctttttcagaacttttgttgttcccggacattgcgtgcctctttccccagattaaccccatctgggctcctggtctgcctcagtcccatggttcctcttcagcaaggcttacctgaccacaatatcaaaaatcacaacctccttaactcatatgttcaaaccctcaatgttatttttcaacttagcatttatcactgcctaccacacaatatgtaaaatatatcttgcaagcccaggagtttgagattacagtgagctgtatcatgtcactgcatccagcctgggtgacagaggaaaggaagactctgtgtcttaaaacaacaacaaaaaatgggacaggtgcagtggctcgtacctgtaatcccaacactttgtaaggccaaggcgggaggattgcttgaggtcaggagctcgagaccagcctgggcaacatagcaagacccatctctacaaaaaatttaaaaatataacttgtttcttttctgtgtttacccactaaactgtatgccacatgagggcagggagttgtgtttcatttactcctcagcttatagagcaatgtctgtcatactgtgcatgctaaatctttgttaaataaatagtagctgttattaatatgatcatttaggtgtaccagaggctctaatccattattccagattctctaagcatttaatgaaatccaaatccaaatgatttaatactgttgtacaagggagaaggtaaacctgtgtgtatgtgtgtgtaaattgaaacaaaagttttgtcaaatactctaataccttcaccttaccgcaagggataggctctgataccttctatgccatattttattgattctaaggtataggcttagatttccattttaacatctctaaatcagattgcatctcatcatagcatctcatcaatataaaatacatttcacaatttgtttttgcagtatatatttttatttcatagtggaatcaaaaatgacatatctcagatccttttgtgaggataagcgtgatgcttgggttttcactcatgtgagatgtgcttccctcaaaccttgttatatcagcatgtttaacatctgatgtaaaaaaaaaaaaaaaaaaaggagagtaatgtatcttttataattgatggcatctttttttttttttttttgagatggagtctcgctctgtcgcccaggctggagtgcagtggcgcgatctcggctcactgcaggctccgccccgcggggttcacgccattctcctgcctcagtctcccgcgtagctgggactacaggcgcccgccacctcgcccggctaattttttgtatttttagtagagacggggtttcaccgtgttagccaggatggtctcgatctcctgacctcgtgatccgcccgcctcggcctcccaaagtgctgggattacaggcatgagccactgtgcccggccaattgatggcatcttatagtcagtgaaaaatcctatttctttttgtaagctgacagcccactaaacttgttttgtagttctctaatggatatcacctacattttggcaaacaatggtttaagacagaaattggaaaattggcccttcccctgtttttgtacagtcaggaagccaagaatgtttcttacatttttaaggtattgttttcttactttttttttattaagatttttttaaacttgtacatttttagatttgggggaataaacacgcaaaaggaagcggggcgcggtggctcacgcctgtaatcccagcacttttgggaggccgaggtgggcggatcacttgagctcaggagttcgagaccagcctggccaacatggtgaaaccccttctctactaaaaatacaaaaattagccaggcatggtagcagatgcctgtagtcccagctactagggaggctgaggcaggagaatctcttgaacctgggaggtggaggttgcagtgagcgaagatcgcaccactgtgctccagcctgggtgacagagtgagactgtctcaaaaaaaaaaaaaaaaagaaaaaaggaatattttgtgatgtgaaaattatataacattcaaaatgtcagtgttcactataaagtgttgtggaacacagccataatcatttttttagtgctgttgtccatggctgctttcacacttctatgacacagttgagtacagtagtacccccttatctttggggcatatgttccaagacccccgaagtggatgcttgaaactgcagatggaaccaaattcaatatatactatattttttcatatatgtacatacctatgatcaagcttaatttataaataggcacagtaagaggttaagcataacaaaataattataacaatatactgtaataaaagatatgtgagatagtgcgtggtggctcatgcctgtaacctcagcactttgggaggctgaggtgggtggatcacctgaggtcaggagtttgagaccagcctggccaacatggtgaaacccatctctactaaaaatacaaaaattatctgggcatagtggcgagcacctgtaatctcagccacttgggaggctgaggcaggagaatcacttgaacccgggaggcgtgggttgcagtgagccgagatcgcgccgtggcactccagcctgggcggccagagtgaaactccgtttcaaaaaaataaattaataaattaaattaaaggtatgtgaatgcaatctctcgctgacaaaatatctttatgtactgtagatcttggcaaccttagcatacgattttgttttctttccttattatgttaaaaactttcccattttcacttaaaggaagcaagcactttacagcttctttttggcatatttcaatcgccagcattgctacccttgtactttggggccattattaagtaccataagggttaattgaacacaagcactgagataccaccaggacagtcactctgataactgcgaccgctcctaagtgactaaggtacagagagcgcagccagccaacagcatggggactcaggacaaagggaggattaccatcccagggcagggctgactcaagagcttatcacactactcagaagggctggcgacttaaaatttatgtattgcctatttctggaattttccaattaatattttggaacctcaggtaactgaaagcacagaaaggaaaaccctggataagggaagactactgtagttggagcagagaattgcaatacctaaaatatttgccatctagtctttcacagaacaagtttgccagctctagttttagaggagcaaaatgaaagatagcaaatttctcagctcaccagttcctaaagttgcgagtgcatccagatgattcagtgcagctcagtatgttccactctgggccacaagggaaagcgaagctggagcttccttgtctccacctccgggagaaatttgtccagagaccggcagcactgcttccgcaggcgaacaacgccgcttgctcttcaaagtcctttctgaggccagatcagaaggtcccactccttttaagccccttattgcccaatcatttttccagtcacgtgtctgaagcagtttatcctgattggattttcagttgttgtccagcttgattgccaaaagttttcctccaattgctactcaaaggaaagaatgagggtggggcttcagggctgctttccaggttgattgagctgctgatgggcatcctccctcctctctctcttgttcagagtctaccactttctctgcagtgtgcctgggccctcagctattggggatgagaagggatgcggagtgggaggcagtccacatgtctgttccaacaaagctcagaggtgagcgagttaaaaagcagatgtctttccagtaggagccccaggggacagggtgggtctcacagcccttgaagaccgagctcccgtaggagtttccaggtgtccaaacagggtcctcactgtgagtcttcaacagctttctccaagcagcagcccactcccttcttaatccatttccaggggtcaaaggtctatcctggttccctcccatgccctctcacttccttccctctgtctctccctcctccctcctccttcactaccccctccctggaaccttctcagctgaatttcaggcccaccctttcactctctttacaggctttgcaacacagattagaaagcgggggagggggagcctcaagagtcccttgacaggtaagaaatatttatatttccacccccattccaacgcaatgcaatcaagtctcaaaattaaaacgaaaatcatttgcaaattaaaatgttctaaagtaccatctcctgataaaactttaaaaatacctttctgggccggatgtggtgactcacatctgtaatcccagcacttttgaaggccgaggcagcagatcacatgagcccattagtttgagaccagcctggccaacatgatgaaaacctgtctcttattctttataaagtaaaatacaaaaatttcctgggcgtggccgtgcgtgcctgtaatcccaggtactcgggaggctgaggcagaataatcacttgaacccagtaggcagagcccaaggtggtataaaagtgtgtgacccatggtctttattcttgtctagggactggggaaaggctgcttgagggcattgcaagtagccaagagcatgcccctggaaaggaaggtgaaatgaggcccgctactgaggtacacctgtagtcccagctatcaaaggctgaggtgaaagatctttgagcccaggaaatccagacaaacctcagcaaaatatcaagacctctgtttctacaaaagaaaaaaaaaatttttttaattagccaggcattgtagcacgtgcctgtagtcccagctacccgggaggctgaggtgggaggattgcttgaaccagggagatcgaggttgcagtgaactatgattgcatcacatactttagcctggatggaagagagagaccttgtctcattcattcattcataaataaataagcaagcaaagtgaaatgaagtgcaagacttagacagtaaagttctaacaggggccgggcgtggtggctcacgcctgtaatcccagcgcttaggcagaggcaggcaggtggcttgagcccaggagtttgagattagcctgggcaacctggcaaaaccgtgtctccacaagaaaatacaaaaaattagcctgggtgacagagtgaaaccctgtctcaaaaaaataaaaaaagaaaaaagaaaggaagacagagaaagaaagaagtaaagaaagagaaaaaaaggaaggaaagaaaggaaaggaaatgtgtattctgcagaactgatattcactccttcctcttttccagaagcagaatcctgctaggaagattccaggaagcctaggcagtggtcaggggctggctcaggtataaagcaggcccttcccctgagacagaaggttgtggcaacaatgcttgtgggaggtgagaaaattgagaggagtgtctagaaatagctcggagttgcatcttattttcttttgctcagttttaaaagtcccaaataagaccacatctagctgttctaaccaagctattctaacccactaatctagtaaaaataaaatcacatggtctgaatataaatttgcatcaggatacatgcctttcctatgaaacatttatgtttccttataaaatgtatcctccttttctgcagaaaactaactgtaatgcatccaaaggtcacagaatgtggtgaaacatcctcatcattgatttttaaaaaaatttttatttatttatttatttgttttttgagacatggtctcacattctgttgcccaggctggagtgcagtggaacgatcatgcagtcttgatgtcctggacccgagcgatcctcccacctcagtctcccaagtagccaggacaataggcagatgccaccatgtctaactgatttatttttatttttgagtagagatgaggtctcactatgttgcctgaactggtctcaagctcctgagctcaagcaaacttcccacctcggcctcccaaagttctgggattacaggcgtgaactacccgcaccctgccctccataactgattcttttttttcagacttcactctgttggccaggctggagtacagtggcgtgatctctgctcactgcaacctccgtctcccaggctcaagcagttctcgtgcctcagcctctcaagtagctgggattacaggcatgagccaacacgcccggctaatgtttgtatttttagtagagacagggtttcaccatgttggccaggctggtcttgaactcctgatctcaggtaatctgcccacctcggcctcccaaagtgctaggattaaaggcgtgagccaccacgcccagccatagctgattctttatcagtctgcctttgggaagtttccactgggaaacactctccaggactgtttcggaccagccccactttccaaacaaagaattccagtgatgagattaaagcttgtcacaatatgtttttcaaatgactggtagaagcagaccttaagattaaaaaagaagaagaaaaaatggctgaaatcttgaatcctttattgctttaaggcacagaataggaaatggatggcgcgtcgggaatggatgcaggtcagggacagaccatcactcatgccaccttgctgtgtttatgaaacagagtgctagaagttaaatttgggggatgcacaaagagatgcctaatcagatgaactcagagttggaattgctgtttgtgagacagttacatcaaaggaagaaaagaaggagagaagaaaggtgactatcaggagaattttccagccagaagaaagacacagaggcacaggcatttcatggcctgaaaaaggaagagcacagagacaagtgtggctccagttaaaggaccagcggagatgaaagatgaggtcagtgatttgggtaggggacatagcagttaagatattgttggtcaaggctgggcgtggtggctcacgcctgttaatcccagcactttggcaggccaaggcgggtgaatcacgaggttaggagatcaagagcatcctggctaacacagtgaaactccgtctctactaaaaatacaaaaaaattagccgggcgtggtggcgggcgcctgtagtcccagctacttgggaggctgaggcaggagaatggtgcaaacccaggaggcggagcttgcagtgagccaaggttgcaccatagcactccaacctgggtgacagagtgagacccagcctcaaaatactactactactaataataataataataaaaacaaaacaaactaaaacactcaggagagattagtggtctaaaagcatatttttacaatgtattcagggttattccattgtttcttaaaaactacctttgggagcatctccccaaacttagtttggaagtgttttttctgggttgcaataaacaagcaaacaaaaaactaccttttaattaaaagtaatccttaaatagagctaacaataaaatcaaacacacaaaaaaattatccattttaaaattttttttatatgaagtcttgctctgttgcccacccaggctggagtgcaatggtgccatctcggctcactgcaaccttcaccccccgggttcaagcaattctctcacctctgcctcccaagtagctgggactacagtcacgtgcgagcacacccagctcatttttgtatttttagtagagacagggtttcacaatgttggccaggttggtcttgaactcctgacttcaagtgatcccctgcctcagcctcccgaggtgctgtgattacaggcgtgagacaccgcacccggccaaaattcatccattaattgtaaagtaaatttcccttctgccccagatcacagttacctgtctctattcccaaaataaatggctgtgtagaatttctgatgtgtccttcaatatatattctctgcatctacatacacttaccttcccctacctttttatgtaaatgggtgtttattattcacatactccgtattaaaattgtgatttattaacataattttactgacattttaatttgaatggagataaatttataaaggggattgatgattaagattttatgtttaaatattcggaagcaaacagtaatgcatcttatcttctgagtaggatgtgggttgaaactgcaaaggcaagcatgagatgtttcattaacacaaagccttgagtgctccaaacccaaaagtcaaagcaacttatcaataaatgccaaaggatgctattctgacatatctgtgtgctgtggtttgaatgcagactccaaatctcatgtgtgggaaacttaatttccaatgtgggactattgaaaggtggggcctttaagaggtgattgaatcatgagggctctgccttcatgaatgaattaatccattcgtggattaatgggttgatgggttaatggcttatcatggaaggggagctggtggctttataagaagagaagagagacctgagccaacatgctcagcctccttcatgagatgccctctgcggcatcaggatgctgcagagacccccaaccaggtaagaaggcttttaccaggcatgccccctccactttgggcttcccagcctccataactgtgagaaattcattttctttataaactacccagtttcagatattttgttgtaagcaacagacaacggactaagacactgtgttatctaattatgtgattcttgttttactatttatttatttagccacttgtcagaaaaatttttttttttttgagataaagtctcactctgtcacccagactggagtgcagtgctgctctcatggctcactgctgcctcgaactccctggctcaaacgatcctcccaccttagtttttcaagtagctgggactactacaggtgtgcgccaccatgactggctactacttttttttttttaatattgcccaggctggtctcaaactcctggcctcaaaagatcctcttgcctcagcctcccaaagtgctggcattgtaggtgtgagccaccacacccagcccaccaaaagttttttcagacatgtacctgagtgattaagagtttaggattggctgggcacggtggctcacgcctataatcccagcagtttgggaggccaagacgggcagatcctgaggtcaggagttcaagaccagcctgaacaacatggagaaaccccatctctactaaaaatacaaaatttgccaggtgtggtggcacatgcctgtaatcccagctacttgggaagtctgaggcaggagaatcgcttgaacccgcaagggagaggttgcggtgagccgagatcgtgccattgcactccagcctgggcaacaggcaacaagagtaaaactctgtctcaaaaaaaaaaaaaaaaaaagagtttaggatctatattcgctctgcctgggtccaaatcctggatgttattaactgtatgactttgggcaagtttattaacacctccattttaaaaaaatctgtactaggaatataataataaatgcataccctctcaggatttgattaaatggaataaaatatatagaattcctagaacagtgccaggagtttgaggccagcctgggcaacatagtgagaccccatctgtacaaaaaatacataaaaaatgaggggggaatagcggtgcacacctgtggactcagctacttgataggctgagatgggaggattgcttgagcccgggggccaaagctgcagcagtgcagtgactgcgtcccagtaatcccagcactttgggagggcaaggcaggaggatcccttgaggccaggagttcaagaccagcctgtgcaacataaagagactccatctgtacaacaacaacaaaaattcttacgcacttagtatttgccagatataatgccaatttctagggcacaaaggcaaatggtaactacctccctggattgttgtaaaaataaagcatgcaaaacattttgtgcccccaatgatcccttcctcatggtgtccccacacttttattttgtgctgtcacaatgagcagggcaccaccaggatactgggaaataatgacgtgtgatttccaagaccaggtcacaaaaaacattttgccttgccctcttgaatcacctgctctggtggaaaccagacaactgttatttatgtcatagcattcaagcggccctatggagaggtccatgtggtaaggaactgaggcttcctgccaacagccaagtgaaagagccatcttggaagaggatccgcctcccaagttggccaagccaacattttgagtataacctcataagagtctctgagccagaaccacacagctaagctgcagtaactttgaagtaataatgatttattgttgttaagccactaagttttgggataatttgttatgtagtaatagatagctaatacagttgtgcttattacgtttggtactcgttactatcaccaccacatcagtgcattgtagaaaacaaattctatgtattaaactgttttgtttcccctctggattaagctgggctcacaaggggaaaggtgcccaccagagtttttttcttttttatgtaatcaagtttttaaaattttattctattctactttatttttttaagttccagggtacatgttcaggatatgcaggtttgttatgtaagtaaacatgtgccatgatggtttgctgcaactatcaactcatcacctaagtattaagcccaatatgcattagctctttttcataacgctctacctccctcctaccctcccgtaaaaggccccagtgtgtgttgttcccctccctgtatccatgtgttctcattgttaagctctccacttataagtgagaacatctggtgtctggttttctgttcctgcattagtttgctgaggataatggcttccagcttatggatgtatagtattccatggtgtgtatgtaccagattttcttttttcttttctttttttttttttttttttgagacggagtctcactctgtcgcccagctggagtacagtggcatgatctctgctcactgcaacctccgcctcccgggttcaagcgattctcctgcctcagcctcccgagtagctgggattacaggcgcataccaccacgcctggctagttttttgtgtttttagtagagacggggtttcaccgtattagccaggatggtctcaatctccttacctcaggtgatctgcccgcctcggcctcccaaagtgttgggattacaggcgtgagtcactgcgcctggtcagtaccacattttctttaaccagcctgtcgatggaaatttgggttgattccatgtctttgctactgtgactagtgctgcaatgaacatacacaaaattatctgaatgattgcagtaaacatcatatatttgtttgccagctaccataataaaataccatagattgggtggcttaaccaacagaaatttattttcccacaattctggaggctggaagtccaagatcaaggtgttggcagggttggtttcttctgaggccttggcttgcaagatggccaccttcttgctatatctttacatgatcattcctctgtgcgtgttcgtgtcctaattttttcttcttataaggacaccagtcattttggattagggctctttcatatgacttcattttaatcttaactgcttctttaaaagccctatctggaaataaagtcacattctgaggttactgggggatagaattacaacaaatgaattttgggaggacacaaatcagcccataacacatcattgccagcatcacatgtggagcattcaactggagaaactgccctaatttctcatttgaaggtctaaacatctcttttatcaaaataagccaggttctattaagaaggctgaatgtgcatctggctcgatcaacaggcgtctggctgcttcaaatgcttgatttttttcattctcagagaatgaaatcaatgttgaaatattgagtatattctatacaaaatcttcatgtcacaatgaataagaaaagtagttttttttgagacaggatcttgctctgtagctcaggctgcagtttttggagtgcactggtatgacataactcgctgtagcttccatttcttgggttcaagtaatcctcccacctcagcctcctgagtagctgggactataggcatgtgctaccactccaggttaattattattattattatttttgagacggagtctcgctctgttgcccagcctggagtgcagtggcgccatctctgctcactgcaagctccgtctcccgtgttcacgccattctcctgcctcagcctcccaagtagctgggactatagacgcccaccaccacacctggctaatttttcgtatttttttagtatttttttgtatttttttaatagagatggggtttcaccatgttagccaggatggtctcagtctcctgacctcgtgatccacccgcctcagcctcccaaagtgctgggattacaggcgtgagccaccgaatccagccactccaggctaattattttattgtatttttagtagagatggggtcttgctatgttgcccaggctggaatcaaactcctgggcttaagcaatcctcctgccccagcctcccaaagtgttgggattataggcaccagccactgcacccagtcaagaaaatattttctaatactgaatacagctaaagaatggatggtaaaccattattgtccagtcaggatcactgtcatccaagtgggacactcagtatttgagattctgggtggtgctataatacttgttgccttggtatctgagtgagcacttagtctaagtataataattttctggaggagtatattagggttctccagaaagacagaaccaatagaatggatgaatagatagatggatagatagatagaaagatagattgatagggccgggcgcggtggctcacacgtgtaatcccaccactttgggaggccaaggcaggcagatcacgaggtcaggagatccagaccatcctggctaatgtggtgaaaccccatctctactaaaaatacaaaaaactaaccagacgtggtggcaggcacctgtagtcccagctactcgggagctgaagcaggagaatggcgtgaacccgggaagcagaacttgcagtgagccgagatcacgccactgcactccagcctgcgacagaacgagactccgtctcaaaaaaaaaaaaaaaagaaagatagattgatagatagatatgtgagtatgtgaggggatttgttaggggaactgtctcatgcaattatgaaggctaagaagttccacagcaggccatctgcaagctggagatcctgggatgctgacagcatggctcactctgagtccaaaagcctcagaactagcggtgtaattctcagtccagtgctgaaggcctgagaagctagggagtgagggtgcactgctagtgcaagttgtggagtccaaagaccagagagccttgagttgtgacatctaagtacaggagaggaagagtgtatctcagctccaaaaggtagatcaacacattcacctttcctctgtttttgttattttcagtactggcctttggatggcacccacctacatggagggcagatcttccccacctagtccactcacactcatgcgttaatctcttctggaaacacagacacacccaaagatagtactttaccaggtttttaggtattctttaatccagtcaagatgacacctaaaattaaccatcgcaagggtatattcaatctgaatggccaaaattatctgatagagccttcagatacttgtacttaacagatgtactcttgggattaaatgagtttatgctcaagaaatgatattagccaggcataggggtgcatgccgttgtcctagctaccgtggaggctaggacaggaggagcattgcttgagactgggagcttgaggctgcagtgagctgcgatggttccactgcactccagcctgggtgactgggcaagaccccactgcaaagagagagaggcagagagagagagtagaaatggtatctgttattttacattaaaagttctggaataggggagtgctatggtctgaacgtatccctccaaagttcatgttggaacttatgacccaatgtgatagtattaagaggtggggcttttacgagatgactaggctattagaggcctacccttatgatgaatgaattaatgtccttatcaaaaagattccatttccactatgctgagagcggaaaacaaacaaacaaacaaacacaaatgaggttccacacagcactcatcctttttgcccttccacccttctgccatgtgaggacaaagcagcaagtctccattttggaagcagagagcagccctcaccaaatctgaatctgttggtgccttgatattgaacttcctagcctctagaactgtaagaaatgtttctgttttgttgttgttttttccgagacgaagtctcgctcttgttgcccaggctggagtgcaatggtgtgatcttggctcactgcaacctccgcctcccaggttcaagggactctcctgcctcagcctcctgagtagctgggattacaggcacgtgccaccacgcctggccaatttttgtacttttagcaaaagtggggcctcaccatgttggccaggctggtctcaaactcctgacctcaggcgatctgcccacctcggcctcccaaagcactggaattgcaggcacgaaccaccgctcccagctgagattttctgttctttgtaaattacccagtctcaagttattttgttatagcagcaaaagcaaattaaagaaggtataatatcaggctctcttctgattccctaggctctgctgcacgaattgttatttccagaagttcccataggaagttctcaggaaatgaaatggatatgaggtaacctcatgtcggggagtcagtctatggaggatcataatcatacaacaacatggtccacccttgctataatctattttttttttttttttttgagacggagttgctctgtcacccacgctggaattcaatggcgtgatctacgctcactgcaacctctgcctcccaggttcaagagagtctcctgtctcagcctcctgagtagctgggaccacaggcacacaacaccacacctggctaattttttggatttttggtagagactgggtttcgccatgttgcccaggctggtcttgaactcctgagctcaggcaatttacctaccttgccctcccaaagtgttgggattacagtcgtgagccactgcacccagctgttttctgttttctgacttttatttttgagacagggtctcgctctgttgcccaggctggagtgcaatggtacaatctcggctcactgcaacatctgcctcccgggttcaagtgattctcctgtctcagcctccacagtagctaggattacaggcgcctgccaccacacccagctaatttttgtatttttagtgaagacatggttttgccatgttggccaagctgttctcaaactcttgacttcaggtgatccgcccaccttagcctaccaaagtgctgggattacaggcacgagccactgcgcccggccttgttttctgttttgtttgtttgttttttaagagatagggtcttgctctgtcagctaggctggagtgcagtggcacaatcagctcactgcagccttgaactcctgggcccaagaaatcctcccaccacagccttctgagtagccaggactataggtgagcactggttaaatttttaatttttttttgtagagacagagtcttgctatgtagtataggctggtctcaaattcctagcctcaagtggtcctccagcttcagcctcccaaaatttgggaatttcaggcatgagccactgcatctgaccgtacaaaatgttaataaactggccaggtgtggtggctcatgcctgtaatcccagtactttgggaggctgaggcagggagatcacctgaggtcaggagtttgagaccagcctggccaatgtggtgaaacccccatctctacagaaaatacaaaaattagccaggcgtggtggcccatgcgtgtaatccgagctacttgggaggctgaggcaggagaatcgcttgaacctgggaggcggaggttgcagtgagccgagatcagagcactgcactccagcctgggtgacagagtgagactccgtctcaaaaaaaaaaaaagttaataaaccttttactcctggcctcaagtgttccggctgcctcagcctcccaaaatgctgggattacaagcatgagccatttatttttctttttttgagacgggagctcactctgttacccaggctggagtgtagtagcatgatcacaactcactgcaaccttgaactcttggattcaagtgatcctcatgcctcagcctcctgagtagctgggactataggtgcacactgacatgctcagctcattcaaaaattttttcataagagatggagggggggtcttgctatgctgcccagcctggtcttgaactcctggactcaagcgatcctcttgccttggcttcccagaatgctaggattacaggtgtgagctactgtgcctggcttttgatttttagacagggtcttgctctgttgccgaggctggagtgcattggtgtgatcatagctcactgcagccttgaattcctgagtttaagtgatcctcctgcttcagtctcccaagttgctaggactacaggtgtgtgccaccacgcccagctactttatgaacgttttgattccaaagtctgaaaaaagttttccagattcatctccaggtcaaataatgtccctgctgtcaggcatcctgctttagaagcaagatgtagcatttttcttcctttacttgcagcaggcagctaataactgttatcctgtgctggaccatccatgttctacgcattctaacatgtgctttacataaaaaattagcccaagtgaccctcactgtgacattacacggtacgtattattaatctttttttttttttttttttttttgaggtggggtctcactttgttgccaaggctggagtacaatggctcatgcctgtaatcccagcactttgggaggttgagttgggaagatcccttgaacccaggacttcgagactagcctgggcaacataggaagacccccatctctagaaaaaataaaaacatagccatgcatggtggcatgtgcctgtggtcccagctacttgggaggctgagaaaggaggatcacttgagcctgggaggttgaggctgcagtgagccatgatcatgctactacactccagcctgggtgacagagtgggaccctatctctaaaaagagagagagagagaaagagggagagcttttaaaaaatggcaaaatgtgcccacagctgatgggcctatttttcttttttttttttttattgagacggagtcttgctctgtcacccaggctggagtagtggtgtgatctcggctcactgcaacttctgcttcccgggcttaagcgattcccctgcctcagtctcctgagtagctggaaatacaggcacccgccaccatgcctggctaatttttgtatttttagtagagacagggtttcaccacattggccaggctggtctcgaactcctgacctcaggtgatccgcctgcctcggcgtcccaaagtgctgggattacaggcgtgagccactgcacccagccaatttctatttcttatagagcttacggtaggaggcttgaagatgggaacagaagaaaaaaggttgaagggcccagctgctgtgtgttgcaagacaggaaattgctgacagtctgcaatgccagcagcctcatgggtggttatcaccaggacagaggcctcagaacaggcaggactgggtgtgctggcactcacggctacgtgcagatagagcccgcccctgggccttggtgtgtgaccttcttcccaggtgcttctttgggaagctgtacagtgagggagatgaggcagactaagggcaggacacactagcataggagcggtggcagctaagtaggctgactgcccagggattgcagagttcacctgcacagtatgacatctctcatccttttggatagattgttctataaggtggcctccacctacccccaactcccaaatctgacattcattcatctacttcccctgaagtgctccctagcacttgccatgagtttgttcactcttgggaccccaaatccaaggcatctcactggctgagattcagtttaccacctcattgatggggggactcttatgtcacagaagtaattttctcactgataggacccaagatgtcgtcctatttttaatgtgggtacaaatactaagtaaatatgatcttagtgttttgccaaaaggaattaagatgtttttaatgggtcacaaattcagaaaggggttggacctggtgggacaggttggtgaggcccagaagctccacttcaagtgcagtactggacatccccttccagtacgggaggtctgacttgtgcagtcaagcccaatactggcacagccacaggccagggatggaggcttatgagtccactggaaaacagggaggactgagtccagggtctcaagggtttagtagtgagggctcctgtgaagaacccttcactcagtggtgttcattaccggccccttccttagtatgttccaggccctgaggatgtaccttgcatgctctgaccctttgaacaccaaagaaataagcaaggagataacagatgccccaaagagatgaatggtgtcatgagatctgggggctgggaccttgtccagcctaaaggtgtaagtaccatggatgagcagtgtcttatttaatcagcaactagagatttcctgaggtttaactgggaaagcaggttcatatactacaagacaccaggtgcttcacattgcttctctttattttcaacagtttctttacaacagtctacacagggattaactcctacatgtacttcccaagccagaatctccctttagaaattcagattctatttctaactctataagatgtatctccccaaagatcacattaactcctcaagtcaacatctgcctatccccaacttcccctttttttcctcactgaacatttgtctgaatgttttttcctcactgaacatgttttcctcactcacactgaacatttgtctgaaactgtggctgctttgttgcttcaagatgcatgcacatcctggctttagtgtccaagtatgcagaatgaagcatttgatatgtgcacccagctagttaggcatgaaacaggggcacaggatgggctccgggtcatagaaggttctgtccccacagtgaggacaggggttggcactaagccagaccatgctgggccgccccaactcacacagcaactccctgagcctggcatgcagataggcaagcctctccaggtggagggtaccatggatgtcctcataactctccagggggacaggatacagcacgtgggtcagattgctcagcccgatgaggtgctgcaggagactctgcaaggcagatatggagatggaattcccgtagaagcttaaggttgtaagctgggagcagtggctcagggaaggcaggagggcaaggagctgatcatccgtgatcccacactcatcaaagaccaggtcctggagggtggcagaggctctctccagcagagcttggaggggctcgggacttacatcggtcagcatgaccccacttagactcaggacacttagctgactgacgctgggactctgggacagatgcatcacatccccttccgaaagccggcagttagttattgagagggtttccaaggggttcatcacgtgcctgcaaatagacaaagcagttagtgctggggaatggtggtagtggggtggggagactggagagaggcccatttcaccaaaacccaaagtcttcctgatgatggttaaccgccaggatgccatgctgtaaaggagcattcaaggagtacaagttcaggtttagtcctttctccatcatttgctgtgtaagtgggtcaagtaaacaaagatctcaaacactcccttggctgatctgtgaggcagggtccaacacagacctcttaggtggtgtgagcatgaattgaattgagagcctgatttgatgtctcaagcaaggaaaggcatcagtgaattttagtatttgaagatacaactgaaaatactttctttcaactcgggcttccttctgccactgcctgggccccagtcacctctatctctgtgcctgatgaagctactagggagtattcacagtggacaaactggggcaaggtcagcaacatccaaagggggttcccaggctgcagggctaccttaggtcactgtatcatcagcaaaccacctatcaatttttgcaatttctctgttgttccttctcccacatctccagaatcctgcatttcccacctattaccctaactggaattctaaatcaccctttacagacaggaaatttgaggcaggtttagagggagcagctcatgttgagaagctggtgagcgcacagcttacaatttcaaatctcacctttgatgggctttcccttcttcaatgccctccttgcttacttttgatcatcttaggcatcacttcctaaggaagaatgcctaaagccacccttgccaggccccaacctcccattacagagttttctaacaaggagtcactgttaatagcatctatcctaatgtatacctctaacccttatgagtagtagttatgtgataccatgcttggggacagtggtgaacaagacgtgttaactggtagtgacttgctcactcttgcattattggtggctggcacatacaagatatcctttattgtttactgcaataaggaagggcttgctctggtctgcagagaaatctcaccatccctcacctgagcaactgatccaggcggcctctaaggaaaaataaagagtccacatagagagcctgcaggcactgcagactgaggaactgagaggtgaactgggcgatatactgctcttccttctccggggaaatgtaggaagatgcatggatgtgggagaggaggagtctacgcagattaatcatctggcccaggtaaggagaaaatttcgccaaggtgggtagcttccaggtacaagtcacttccaaatcttcaatagagtccagctgcaccattttcaggatcatcttgatatcctgcatgggcattgcaaaaatcttcagcttcttacagcacaggcgtagtacatttttctttcgcttcactttctcaatgaggtaggagaacaattcatcacaggcaccttccttgaggaacaggtctacgagcacctctactggaatgaagggctgctctgcctctgtgctcaaaccatctacttttcgcttctttgtcatgggctgagctgcttctggctctggaaatgagtacagactggccctgtttccagaccatacagtccagaagtcctgatgagagttcttccgtaaatccagcacttgaagtttccacctcctgtggggaaaaacaggtaattagctgagatgatgctttaagatcaactcaaaataagaccatgagtctcataatgtaggtaagaaccaaacagacatccaccttagatctgcacttttacttcgtacttcaggcatcagctgctccctttcccactaggatcctgggatccttcctggtccccaattcccaccccaccaggaggaagcaggtgcatgttccttcagacacctctgcattttaatcagtgccccatgtccagaagcccattccaagagtgacccctgcagtagccccaaggcctccctgaacttccttgctggcaaccatcagagcctctggcccagccttaggcgctccatgctccctgaccccagctgcatcctgctcaggttcccagggccccacaccaagctgctaggtcacccttacctggggcgaacctcctgggcaaggagcacatcaagtccatcaagcacagctttgaaggtctccaggtgaagatgttgtcccttcatcagcactcccagagggaggcaggtgaagggccaggcctgcaccattgccttcagggtctggctgtgtctcccgtcaaaggctgccatgaagagtggcgggaagagctccctgggcagcaactccagggcggcaatggccagggcctcatccttcagcaggctctgccctgccagctccacaagtctccgtgggcttgtccacacactcatgctgatgtatcggctctgaatggaaccctgaggaaacatacagggaacaaggcatccctttcagcccaagcataagcaactctatcttttcctcacccttctgagggaccaacttagggccaaagtcactgtgctagcaacagcaggggagttctcagtttaccccgattccactctgcactcggtggccacaaagccacagctctgctggcaccaggatgaacatctcatcaagtgtagaggaggggacaggacggccactggcaccatcttgtatctacccactactctatttaattctagtccccctgggaagtgagaactaaggagcctgagggctgaccctgctcattttgggaaaaagtttctgatgatcactcaaaggcaattcaaatgggagtgtcacatagcccaggacagcatccttctctgctccaacaaataagccagatgggaaagatgaggaacacacacacaatgcacaatggatgccattatgtttcactaaaaaattttaaatgagaaactacagaagcagcacaacagtattacatagcaattggaagtacaataaaaaaaaaacattctgagacatgtattttaagtgcgtctcttttacgtatattaagagttactactttgacatggaaatcagcggagcaaacacttcacagtaaaacaaagcctggttcttttctcccaaaacattagttttaaaatggagaaataaaaattgtgtatatttatggtgtacaatatgatgctctgaaatatgtatacattgtagaataggtaccttaagctaattaacatacatatgatctcacatatgtgtggtgagaacacttgaaatatactcttagcaattttcatgtatacaatacattattaactacagttaccatcttgtatactagatatcttgaaaaagcctccaccctccagcacagtggctcatgtctgtaatcccagcattttgggaggccagggtgggagaatggtttgagcccaggagttcaagaccagcctgggcaacacaaggagacctcatctctattaaaaaaaaaaaaaagaaaaaaaagaaagaaaatgtctttaattccaaagcatctgaaaagaaaaagaaaaaaatctatggaatattttttaaccttttagttaaaatggaatattttttaaccttgtagttaaaatggaatattttttaaccttgtagttaaaaaaaagcctaactagtaaatcactgatttaaaaaatcataaatgatgcaaattataattgcttgccacatactatttaaattgtaataaagtaaaattcaaagtagatgtcttttattttccaaaaaaaaaaaaaaagccgtttaagaaattatttttaacatatacaaaatggcagaaatcaaaatgtttgggattcaatataaataataaatgttccaggtaatggttatactaattaccataatttgatcattacatactatatatgcataaactgaaatttcacatgtaccctataaatatgtacaattattgtgtatcaattaagaaatcaatccaataaccaaataaaaatgtttgggattaaggcaaaactacatttagagacaagaacaaagcctgttcctttgtaaggaaagaaaaaggaaaaccatctaagcagcattggccctcatggcccgtggagaccctgaggtgacagtagaaggaggcagtggccatagcctgaggctcccgactcaccagacccagctgtggtgcagaagccatctgcccagacctctgggaagaccacaacattgactccatggcctctgggtccctcctctggcccctctgaagctattacaggcctttctgggcatacctcccctttcaactccacgctgccaacggaagagccaaatctaattacattcctggatctccagccagtgaatcctgatggggttttttacttacttcaggttcaactgattgaatgggatgtctatttacaaaaaggaaagaaaaagtgaacaaaaccacccagagagtataactgttaggggaatttttggccacatcaaaattacccaaatagtccagttaagatagctttatgaagagcatcatgacatcaccccttcccactcccaaacaatccccaagtatcaaattgtcacttataccccatgttccctaacacagcaaatcacatgcctatccaaggaaaaagggaggaacaacagaggggtggctggtcttccagactttgaaagtcaaggctgtcctgaaggaaggtgggtcaaaattacactacaattaggagttagtcagaagtaaggctgggcatttgtaatgggactgagtggattaccacaaagacagataggtttttttgggggcggaattgaaagactttggcctggatggagtagagaaattaaaaaggggaatggctaaggaagatgaaagatagttccagtaaagccaaggtaatcactgaggcagggagggagttcaatcttcctccctccctagagggaaagggtgttttctcccagaaagtcaggatcctcttggcaaacagccttgacaagattaaatctaggaatgtgggctggagaggtgggatagagagtaatattggtgaccaaacctaggacagcaacattttcaagtctgaaagaccttgtggtttcttaggaatcttggagccaggaaagaaataaacaagggctgaaagcacacatccctgcaattaaagaagttgtcagaagaccttctctttatggttaggtgtcctcttccacactggggctgttcacaagcagcaggtcaggcctttaccacaaacataatctccaatggccagccccttcctaagtattactaatgtttccacacttcaagaaaacagctgttctttcttgcccctaagctgctcaggtacagagattctggtcagcgagatgcaatcaggcctatcaattagactcagtttttctctatttccatgctaggcacagtgcacaaatacattttccgtcacaaaaaattgaagttatatttggcatttaaggatctgcttagggatgattcctatcctgggcctgatcacccactggtgcttttgaagttttggaacctctccacccaaagaattctccaggccattctctgcctcatgcactgtgaagtccctacaattcttatattctactggcaagtgtccagctggaatgtcttgcggcctgactttgtttactgtggcctgcgtaaggaggctgtaattcgttgaaggatgttttccattttggttctctctctggagactttctcctacttttcaccctcaacacctaatggcctttgtgaaaaccgggttaaactacaatttgttctacatttcctttaattcccaggcaatcatcttcactcatcagctgcgggagactgagattagtaataaaggtcattgtcaatgtccctaattatcaagcagctactgggcacagcaaaggccgcagcagctctcattcattacctcaaatagccttcacagagaatctaaagttcactgtcattttcatttttagtcttgtaagtccctgactctgtctggggaagaacctgctcagctccaagcaagcaggaattggtagcccttatgtgaggagtttagaaagagtttcatttccctccctatcaaacaatctaagtgttagaaagggctgataagcttcacataaaccatggaaaaacaggaaaactgagtaagtccaacagttaaggaagcttccatgggatccccgcttccaggagatccaagggaggaggaggaaccgcgatcaagtgtgagttgtgtaatctctgagctgtgcaatctccctgtgaggcagtgacactcctctgtccagcttcacactgccagtttgtccagtggcactggaggaagcagcaccaggggcacatttgcacaaaggtgctgtccttcctcccagtataagggagaagtgaaaagactggggcccagcatgactcctagggtccagacatgaattggggagatatttctgcatgtcctgtctactggttcttatggtccttgtgggctgcacaggccagagtggcctctgagctcatcaggtgggtggtctgcaccctcctctctagtcatagaatcccagtggggacccccgaagtatctgcaccaggtccttcaggtgttttttttggagtgcagtggcgcaatcttggctcactgcaacctctgcctcctgggttcaaacgattctcctgcctcagcctcccaagtagctaggattacaagcacacgcccccacacacggctatatttttgtatttttagtagagatggggtttcaccatgttggccaggctggtctcaaactcctgacctcaagtgatctgcctgtctaggcctcccaaagtgttgagattacaagagtgagccaccatgcccagcctctttttcttttttagagacagggtcttactatgtttcccagactggtcttgaactcctgggctcaagtgatccacccatttcagcctcccaaagtgctgggattacaggcttgtggataccaacagcacccgagcacggtcccacagtccaacgcactgtgccgtccttgagcctttagttccagcacaagtctcccggcttcaacccaggttgcatgttctccctgatctccccaggtggcacccaaggatgaggcagtgcaatcttgttgctcacttcccaggaccgacacttacccctaatggcccaagcccatggggcagtgagatcaaagcctcctggagctcatactctctgacaccactggaagtgtgggcttttgcgtctgattaccccggggaaaggttctgaatgtaatcgtggctttggcaataaggtccacaatgcattaagatttttttttttttttggaggaggagtttcactcttgttgcccaggctagagtgcactggcaccatcttggctcactgcaacctccacctcctgggttcaagcgattctcctgctcctgtctcagcctcccaagtagctgggactacagatgtgggccaccacgcccagctaattttttttctatttttagtaaagacaggatttcaccattttggccaggctagtctcgaactcctgacctcaggtgatctgcccacctcggcctcccatggtactgggattgggattacatgcatgagccaccatgcctggcctagggttaatttttatttttggagacggagtctcgctctgtcgccaggctggagtgcagtggcatgatcttggcttactgcaaccttcgcctcctgggttcaagcgattctcctgcctcagccacttgagtagctgggactacaggtgcatgccaccacgcccagctaactttctgtacttttagtagacgcggggtttcacagtgttagccaggaatggtctcaatctcctgacctggtgatccgcccgcctcagcctcccaaagtgctgggattacaggcatgagccaccgtgcccgaccctagggttgactctcatacaaagacagcacgggaagtgaaatgctcttttgtggaaatgaccagaaacaataaaagcggctcctgcctcttcgtctactgtgagggacctcaggatgcagctcccatctggctcgagtgacaaggacagaggggaacagggcttctctgagcacctcagacagctcaggggaccttcttacccacaaacgccttcgttccattttgaagcgacttaggctggcctcaggacctccaacgcttggatttctaggtctcagtcacttgttgccacgcacgtctgagagtaataatcaaaatgctccaaaaagaagaatacatgtataatatttacgaagcaacggcctcctgtgaaaacctccgcaaatactgctgaggaaactgacaactggcgactcaatcccgccctttcagtgcaaatctctggctccaaacctgagcaccagtgtttcctgggctgaaccagggggcaggaggaacaacagaccatgtggttggtcacaagtgacccctgtggtcaaggaccctgactacggtcttgcagcgacatttctgcctctgctcccgccttcctaggacgcctacgccactgcctgggccgtccccaacccccagcaccttcagaggggccgagtcccagagcatccaccgcattacaaatgcgcacccaccctggagagctccaaccacgagcaccgccgcctcggttcaaggcatccttacagccacaactcctcaactggggccaattttccggggcaggcggcccggggtgacccaagtggcgcacattattttctttggtcttcaacccatttccagagagaaaacagggacccgggacaggggtggtgccgggggcacaagcccaaggtcaccctgcggggaagcggaggaatcagggctcgaacttacgtttttcctcagagagttcaccacaccgcgaagttgctggaaggaaagaacgagacaatggctcagctaagcgccctagccgctgcgtggggcggggggggcggcggtgggggccggggggctgggcagcctggtctgaccaatccccgtttctcagtccttccagggcaaaatctcacgagatccagtgaggtcgcccagagagtcgagaggggcttgttttcaaagactgggaggaggaggggcagtgggggaggggcagtggggggaggagcagaggagaagggagcaggaggaggggaaaaggggagaggaagttggagagcagaggaggctgggggtggggagcagatgggggtggggaaggaggggagatgggggtggggaaggggggcgggaggagggttaggaatgggggaaggaagacagggtgggggaggggtgggcatgggggaaggaagacagggtgggggaggggtgggcatggggaaagggagacagggtgggggaggggtgggcatgggggaagggagacagggtgggggaggggtgggcatgcgggaagggagacagggtggggaaccgagaagaaagacagtggggggggatggaggaaggaacacagggtggggtggggggtcgggatgggggaagggaaacaaagagtggtggaggcgtggggattaggaacggagacagagggtgggggaggggtggggtgggggaagggagacagggtgggggaggggtgaggatggcggaaggtagacaaggcgggggaggggtggggatgggggaagggagacagaagggggggaggggtggggatgggggaagggagacagaaggcgggccagggcgggaatgggggaagggaaacagggtgggggtggggatgagagaagacagaggttgggggaggggtggggatgtgtaagaaaaacaaagggttggggagggggagggaaaagaggcagagagtgggggagggggtggggatgtggaaagaaagtcagaaggtggggggtgaggggtggggatgggtgaatacgtgatggctgcggcctttcccaccagacagtagggtgggggcagggtggaaaaagggggtgcggtgggcgaatggggaggcggggggctgactgggagtgtgggacggggtgttctgggatcacggagacgtccaagtctggactctgtcctgggtctgtgcttctggcgacctcccttttcttcagtgggatgcggggtgcaggggccggttccaggtcccctgagctcaagtctcgccccaccccgccccgcaagtctagaaaagatgcccctgcccttggctgggtaatctctggatttacctactgtctgtaaccccccgggctgaagagaccaccccccgggagtcaattaacttactctctggagcgcgcgttcctccctgctcccaggagtcggtttcccaaaactttctgaggcccgcgcatgctcccctcgactccccgtgtttccactctccacagaaatccacgcattcacgcccctcccctcccccgagcctgcagaggactccgccctgctttccctacattcagggctgctccttttgtcgccaatacaaacctgttgacaggtcacgcctgggaagcgggtggggtgtcccggagcggtgctgaggcgctgcaggcccggcttctggctgcgggggagctgtaccctgaagcctcgccggaactcgcgtctggggccagcagggggcactagagtcaacagggactgtatgcaaaacccacttcctcccaggccctctagggggatggtcaggcttctgcagagatggggaggatcctttcctggtaaggggagagggacgggctaggagccaagcggaaggaccccgtgttcaaggcccttcaagggacgggacaggcgaggaatctctttgagtcttttgaattgttttatcagtcaggcctgggaagtactccgcctccacaaactctgttttcctgaaaggggtcgggggggggaccccaacatctcctgccacaggctatgatgggcatggtggctaagagcaacaggccgcgtggtgaggctggctttttgtggctctgccctgccattccccgaggcatccccatgccagtgaacagagctgcgggttcccagctgcacagatgaatgcacgaacaaaacataggtccatacaaaggaagtcattgcattgatccagattcgacctgggattgtcgcataaaacagggctgataaaaaccgtcgtgttttcaccctggaaacagagactcagcctccccctctttgcttgaggcattcagcaaaggtttgtccttgagtggctgtggatgctcaaggacttacgatttctgactttataaagtttagggtgaaaacaaaaaacaaaataaggagaccattgttttaaagtggccgttgtagctaattatctcaagaaagcaaacaggctggtactgaaagttacacaggcgggcggctccctgggagggttgcccagctctccttttctgagacctgagcagggagcagccagaggagcttgaagggatggtgttcagggcatgggaacaggctgcacacatcttcacggagtacggtgcttgtccagtttgagaagggaaagaaacgggagcagagggctgatgagaaggcagcagatggatagtgcgggattgaaaaggggatccatttgaagactggccaccattatttattttcatcatctgattgctgttgctccattgagatcgatgcgtggagaacaagttggggagtggaacaaatggcagggaggggagagaagtgagtgaacatgaccctggtccagcctcataggacagagcgtggtcatgaagtccacagaggaggacaggtagggaggaatcatggcatggccaggttgtagggcaagaggcagagaggagagaggattgtggaggatgcctgcggagtgccgactgtcagtcgaggctggtcctttatttatttattttttttttttgagacggagtctcgctcttgcccaggctggagtgcagtggcgcgatctcggctcactgcaagctccgcctcccgggttcatgccattctctcgcctcagcctcccaagtactgggactacaggtgcccgctaccatgcctggctaatttttttgtttttaatagagacagggtttcacgtgttagccaggatggtcttgatctcctgaactcatgatccgcccacctcggcctcccaaagtgctgggattgcaggcatcagccactgtgcctggccaaggctggtcctttcttttatggcgatgggtgtttgaaagttgcacataccaaaataaactcactatttgttgacccaaagtaaaaccctgagggtatgaaagggaagggctcatgcttacatggctgagataaaagctgtctcaggaagctgggtgtggtggctcacccctgtaatcccagcactttgggaggccaaggttggaggatcccctgaggccaggaattgaagactagcctgagtgatatagcaagaccccatctatatttttaaaaagggttggctgtctcgggacttttcgaaatagccctgcaagacattcctgttttggaatcacaacaatttagataagatgcttttgaaagaacacctgcctaggcacagcgtctccaccaatgaactgatgccaactgtggttttgagtcttcataaccggtgaactgtttgcaagcagcttatttaaatctctttttttgccaatacaaccttccctttgccctcccctcttgagatgcatatatggcttgccatagctgagcatcttaggttataatgctttttctcttttttaatttttttttgtaaatttatatttatttttatatttatttattttttgagacagggtcttgctttgtcacccaggctggagtgtagtgcataatcgtagttcaccactgcctccaactctcgggctcaagcagtcctcccacctcagcctcctgagtagctaagacaacaggcatgcaccaccatgcccagctaatttatgtatttactttattaaaaattttttttttttggtagagagagtctcactgtgtttcccaggctgggcttgaactccaggcctcaagtgttgctcccaactcgacttcccaaagtgctgggattacaggcatgagccaccatgcccagcgtataattttgtattctaattcctgaataaattcaacaaatttggaggtgttttttgtctgatggttccttttggtcgacaactggaatgggagaggaacagtgtgagggcaaacatcaagtgctttgctgagctccgggtgctttttttggataagacacagaaaatacaataagatgtctgtaatgtttgatttttttccaggtttcttgaggtataattgacaaataaaaattgtatggattcaaggtgtacaattcatatacattgatccacatataccttgtttgatgattaatcaaattagttaacacatctttcaccccagcagtcaatgtgtgtgtgctctgttagcaaatttcaattaataatatagcattattaactatagttactatgctgtatattagagtctcaggatttaccatcttataactaaaattttgtagcctttgaccaacatctctcattcctcccacccacagcccctgggaactaccattctactctgcctctatgagttccactttttgtgtttcttttttccctttcctttaattttttttgtatttgttatattaccaaaccatgtcaaaagagttccactttttagattccacatattattagctcgtacagtatttgtctttctgcatctggcttatttcacttaacataatttcctccaggttcattcgtattgttgcaaatggcaagattcccttcttttttatgactgatgatgtctgtctgcaatatttgaaaaaaaaatgcagatcacgtgaatgattgtctaatgtaattctattcatgtaaaattgtgtatgaccataacagtcactcattcattgcttcgagttctttacaatcggatgccatattcctggggctctgctaggcctgaaatggggagtaggagttacaaggttcctgggatatcagtaattcatatttgtgaatgtcttagataagtgggctaacatgtacagaaaatggtcactaaaatgataacactgtttgttataaaatacttttctgtattctcttgaactttttttttttatcatttattagactgcttcagctgccataacaaaatatcacagactggatggattaaacaacaaaaatttatttctcacagttctggaggctgggaagtccaagatcaaggtgtcagcaaggtgggtgtcattctgaggcatcttctcttagcttataggctgaggccattttgcgttgtgctcacgtgacccctttgtgcgcatgtgtggagagagagcatgggtgcttcttcttataaggatgctgaaagttatgagaacccgacccttgtgacttcacttaatcttaattacttccttagaggccccatctccatatacagccacaatggggattagggcttcaacatatgaatttgtggtggggggacgcaaacactcagttcataaacatatgatttttttttccttgatcggcaatgaaaatagaggtatcttcattttggaaagtgagagtcaacctgtgctgaattagagtgatgacaagagatactttaagactgcaatgagggaagcaagggatggggacgcatttgacagtctgttctgctgtgctcctggaagtgagagaggctgagtcgggactaacctttgcacggatgagatagagaactgagagagaaaagtatgtatttttctatgaccacctaaaataaacctggagttgaagggaccagcactctcaacctaaccattctgggaataaaaatcatagagacctcgctgattaatggaaacaatttgcctttcgattttctaagcaggtgaatgcaaggagtttgtgaactttactgctgttttcgtgtttttttaggtgaagacactgacagtaagaaaaggcaaaccacaggtccaagacaaagtggtcaagtcaagaaggaactcaggctgtgtagtcctggtgcaaggctccttgcccccagcgtggggtcacactggctggctgtgctcccacgacacttagtgcatactgggctcctgacttaataacacgtgtttgaaatggcccctgattcccaatctgctgcaggattctgcagatgcgcaacaggccacagtggaaggtcttggagagaattcagagtggcttgcctacgttcccatgaccgtttgtcctaatgggagaatcaccattttggaaaattcttttggaggccaggcgcggtggctcatgcctgtaatttcagcactttgggaggctgaggcaggcagatcacctgaggtcagaagttcgagaccagcctgggcaacatagtgaaaccccatctctactaaaaatacaaaacttagcctggcatggtggtgcacacctgtagtcccagctacccgggaggctgaggcaagagaatcgcttgaacctgggaggcagagattgcagtgagccaagattgcaccactgcactccagtctgggcaacagagtgagactctgtcttaaaaaaaaattcttttggggctagctgtgaatgagctcagagggaaaggcaggagccttcaggtagggagcagcatgattccaccccagattcaggcctcctgggtgtacagagggcaggaggatcctccccaggtatgtgagaggaagggaagatgaggtgtttgggtcagtgaacacactagaaatccaggtgctcactgatggattgtgcttggcatctctgttctgccaatccagcctcaaagcaactttggaagaggatttatgcgcttcacacgcttccagcttgggccagagcatctgcacactcccctgggtataggcctccagggcttggagcaacggaagagctaagaattgtcagtgctcaggaggcagattttcagggaggatcctcttgcatctcaggacatggaaagggctaacagagccttaagtgtcctgtcccagtgctggggtctcagaaggcagctctggggcatctccaccatggtctgacttctgctgcttgaaaccattctccctcacggcacaggcaagagtcctcaaggaagagcacctgggcacctgggttgactcttcctctctccaggtggagagaaccagtagagtttacctggggtcatgctctgagttaatccccctctgcatttctttctcttctcaggggcctgggctcagccttgactcagccttcctcagtgtctgggacttggggtaaacagtcaccatcttctgcactggaagcagcagtgacattgagggttctaaccatatctcttcgtacctacagtgcccaggaactggccccacactcctcatttattatgtccattctcaacccttagggggtcccagcttgattttcagtctctaggtctggcaacacggccttcctggccgtctttggcctctagcctgaagatgggcctgacagtcactgtttgttctgggacaaccatagcatttttacccacatgtgctccaagtccacggggaacagagaccaaatctgccatgagtgaccagtgtcacagggcttcacaccagtcaggcagtcagatggtggtgtttgctttcatttctgctcatcatcccaagggggtggacgcttcaggaatgggaccctatgcaactctcattgctctttataatgatgtgggaaagagaaaccatctcccaggggacttggctttgcaaaaatgaaaataaaagctccctcctccctctgtgcagtgaatggcctctgaatgcagacttggtctccctcttcagtggcaaggttggaggaagaacaacagcttcttattgcactgagacaactcaggggccacctcatttgaagatgtgcatcagtgtgagcccaggtattcctgtactcaatgatcgaggtctctctccttaccttgtctccacctggatctgaccaaagtgactgagatgatccaggttctagttttctcttgctgtgtaacaaatttctgcaaacctagcaccttaaaataacacccatttatgatctcccagttttcctggatcaggagtctgggatcagcttagctgagtcatctgttcagggtcttcccaacctgaaatcagggcattagcttggctgtgttttcatctggaggctcaactgaggaagattctgtttccaaacttactggcagaactcacttccttgctgctatatgactgaagccaaggttttggggggctatttgccgtcagtgcccgaagctcctagagttcctagaggtcacccatagctcttttgccatttaatgtaacctaatgaaaagagagatattccatcacctttgccatatttattggttagaagcaaatcacaggttcttcttgaattcaagtgaagagattgtgcaagggtatgactcatttggggtcaccatagggtacatcctcagtaattgtgtgcagtcaggactaggggaggagattctaattatacagagaagacttgtgccttctattcagaagttaagaagacatcctttactttttaagacactctgtcattttattcattgatttttagtggtgttctagaaagcagattttccaagcgtaaagcacaataatgaaatggcagagctgatgacagttcagatgctattagatgggtgtgcagatctaggtttagagccaagggatggagtagtgtctcttggtctccactgtggagaggccccttgggaaaacccaccacccccatttctcctcactccctgcctggacccatggtctctgcttggtctggcctatgctattaaaaatatacttcaatgatgatacttatgtcttgtgtttctctacactctttgtctatttgcagtggacagcacactgcatgctgatatcaaaaattattccagcaaattcaaaaataagacagtaaaaagaaataaaagacagttttacaatggaagagacagaaatgaatagttgcacttatgtttgatttagctgttaaatctaagagaaccaactgcgaatgagtagagaaagcggtcgttgctgcatactgaccattactagtgtgagatactgggggagctaggatggcctcctcttcctcttccttctcttgcctctcctcttctttcttttttggtaaatatctttcctagatcagcggttctcaaaactttcggtctcatgacctaatcacctcccagaggccctacctccaaataccatcacattaggggttaggtttcaacatatgaattttggggggacacgaatatttagtctagaatgctttttcaagaaaaggaggacagaaagatcatactacagtggcttttaaaaattagatatggacagcttttgtttctggaatatgtcagtgtgctgttgtgcaaagcatcccgggaacaacacctcagaatgtttcctttctgtgcctcagtaagacttgaaggctggtagggtagcctgagtcgtggctttcaatgatattcaggtcctaattcctgggacttgtgaatactgcctgtctttgtccgttttgcattgctgtaaaggaataaccgagtctgggttatttataaagaaaagagttttatttggctcagggttctgcagactgtacaagaagcatggtgcccacatctgtttctggtaaggacctcagaaagctttcaatcttggtggaagggggaggaggcatcacatggcaaaaggcagaacaagagggagaggagaggtgccacattcttttaaacaaccagctctctcatgaatgaactcactgatctccacagggagggcaccaagctattcacgagggatttgcccccatgaccccaaaacttcccaccttctttttctttttcttttttttcttttctttttttttttggagtctcgctctgtcacccaggctggagtgcagtggcgtgatctcagctcactgcaagctccaccttcccggttcacgccattctcccacctccctagtagctgggactacaggcacccgccaccacacccggctaattttgtttttgtatttttagtagagacggggtttcaccgtgttagccaggatcattctttttctttttcttaacctctgggagcacagaacataacataggatttggaggggacaaatatccaagctatatcattactttatatgagaaaaggggttttgcagatgtaattaaggatcttgagggagacattatactggattatgcaatgggccctaaatgtagtcacagatgtcctttcgagagggaggcagggggagatttgaggacagaaaaggagacatgaacagcggtgggatgatgcagctacaagccaagcaatgccagcagtatctagcagctggaagagtcaaggaaacagattctcccctgggacctccagaaggaaccagtcctgctgataattttatttcagttctgtaagccttcttttggattttagattctcagaactgcaagaaaataaattgctgttattctaagcccctaagtttttgacaacttgttgtagcaacaatgggaatctgatatagctaaggtaccatacattttgacatcttctctatatatggtaccattctgatttgtactgtgcaaggcttccttgccctctcactggtaaaccttggtatgcaggaaattatttttgtacattctccagtatattaactttggttataggtgatacattatatctattgcaaattatcattttgtctcctaatttgcatcaaccatgctgcttgtgtctatttatgactgattgtgtaggaaaattcttcaagaaaaaatcaaataggatggtaattcctgcatcttggaatgcctaaaaatcttctggcaataactgattacatagagaaaccatctgtttacttccttcaggaactacctggcaccttctagtgctttcccttgtggaccacaggtgatggaggctgggccctaatccagcacacacctccagtctagcgggcttctggtccagttatttacctacaggtattttattgatgttattcttcctctgatgacacgctgatttcaaaacatgcctaaaaccaaagacacaggatctttgaagtcccttccctcaaatatctgaggcttttccccaattgagcagcagttcacatgcttgtaagttttaaatgtgttaggcattttactggaaatgctttatatgcttcacactccacaggacttcttattcccagctcattgattgaggaaagtgaaatctgccatttgctgatgggccaatgtcaaggccaatgtcccagatcccctgtcaggacaaaagtgtgatgcagccagaagtcagccctcacctgcaaatgctctcctgaacttgcctaccctggagggatctgctcaccaggcagattccaggcgatgcccaaagcactccctaataaaactctgtgtgctcatctccgccttaacttctgtttccaggagacccagcttgtgaccattgtttccaggaagattaccaattgtctctgtttgccctggaccgaaggttttcccaggacatagatctttcagtgctaaaacaggacagtcctgagttatcttaggaccaggaatgtctatgaaaggagacacttgagagatgggattctggagccatggagaccccaatatgggggagttggaggtaggggcgcgagggtagatgcgcatatagcccctaccatggtggagcaatgcagtgtgtaaactttttaccagtggtgaatagggatgatttacctataggaggaaatgaaaaagcaggaccatgagtcagacatttgagagacgtgaagaaaacagaacattaaaggaaccaattccacagctttctctgttggaacagtgtggtagtactgatactaagtgtgattgatgatttgcaacagataaaatgctggaatgattaattagcaatgaaaaactagaagatgtggggcaacaaggctccagctccatcctcttagggtaccagctgggctcaagaattgacataaaacagattcgcaggagacaaaacatacaaatttacttaatacaagtttcacatggcacaggagccctcacaaggaaatgaagacccaaagaagcagttagagtcagttacttatataaggaattggtcaaagaatagtcagttgtgaagaaacgactaaaatatgtggggaaaaaagccccagaatctggtgtatccaaataggactccactctgatgacaggtttcttgggctgagattcctttgagccccatccaacttcttcccagctgctgagaagagaaaatcttttagaggcttcctggaattttcccagtccacactgattttgcttaaaagataaaagttattataataaggtctgttcagcagtatctcagttttgacttctcatccctgaggataagaatgttgcttttccttctagcatagggagggacagggtttttcacatgggacttttgtcttctgcttttaagaaacagaaaacagcagaatgatctttttgcaactggtgttttcaagtgccttttacttaaatagtcaatttgctagaccggtacttttttatttcttttcttttttttttattatactttaagttttagggtacatgtgcacaacatgcaggttagttacatatgtatacatgtgccatgttggtgtgctgcacccatcaactcgtcatttaacaccaggtatatctcctaatgctatccctcccccctccccccacaacaggccccagtgtgtgatgttcccccactgtgtccatgtgttctcattgttcaattcccacctatgagtgagaacatgcggtgtttggtttttcgtccttgtgacagtttgctgagaatgatggtttccagcttcatccatgtccctacaaaggacatgaactcatcaatttttatggctgcatagtgttccatggtgtatatgtgccacattttgttaatccatagactggtacatttttaactccatcagagcgcaagccaaaaagcttcctcctgggctgaaaaaaaaagcttccccctgggctgaaaaaaagcttcatcttgggctggaaaagctttttggcttgcactcttcctctgggcctgagccttccctgccctctcatctgcttggacagagggcagggaagactgaagcccagaacttaatcctaagtgtagcagaccatcgggaccctgacagggtaacagtggggtactgagtcacgggacgaggccatctggattcacgcacctgaaaatcttgatgtccttgaattttccaaacctgcagaagtggccctcccttactcattgaaacccatgtctcccttccttttgcctgaagatgatgcagagacctctgacctgtgagattgtatccaccaccacaagtgtccccagaaatctgccaccacctcctattaagaccaaaggaccaataactagaattgagtcccaaagaaacctggcaaggaatgtgatagacctgctgcagaactaaggagctgcagaactaaggagctccagaaccagccaacacgtgcagtgggccccaggcgagtgtgtatggggctggattctgagggtgtaagatcaaagtgcaaaacctaagattggattggggagggtttatctgctggaagcactctcctgggacgcaggctttaaccccctagcaaagacattgaggcattctgcaagcccgccgcaaggattgcccttaggaggacagagaaagcaatggtccgtaccaagcaaggtcataatgccagatgtgctgtggcagatggtgggagaggaatcaaaaggtcctgggaggccaggtgtggtggcttatgcctgtaatcccggcaccttgggaggccactgtgggagaatggcttgaggctaggagatcaagaccagcctgggcaatatagtgagaccctttctgtacaaaagattaaaaaaaattagtcaggcatggtggcacactcctgtagtcccagctactagggagtctgaggtaggaggattgcttcagcctggggagtttaagactgtagccagctgttccagcctgggcgacagagtgagaccctgaaaaaaagaaagaaagagagagaaagagagagagagagaaagaaagagagagatggagagaaagaaaggaaggaaggaaggggaagggaagggaggaagggaaggaaggagagaaagaaaaaagaaaagaaagaaagagagagggagaaagagagaaaggaaggaagggagagagagagggaaagaaggaaagaaaagaaaagaaagaaagagagagagagagagaagggttctgagagtgcttagctggaaaggcaataccaggtactcatggacatctccccaagtgagagaattctcaggagggcctggggactgcagtctgtaattgattgataagcggtgcactggtgagagaaatccagcatccttgagaaactcagtgggtagttctctagaccaggccagcaggggaagctggtaaggaagttgatagcaatacggatggaaggaccatgcagtgatagtgtcacattgtcagggcttaagcataggagccaggtgtgtggcaaaagatgaagtggcagcaaggcacctgacattgaatgatggagtcagtcagtatagcatggcacctctcggggcaagatgcataagccaccaagaaagggacagcttctaatctttttagcttattttttatttttttgttgagatgggggggtctcactaggttatccagagtagtctcgaactcctggcctcaagtgatcctcctgcctcagcctcccaaattgctgggattacaggtatgagccatagcttccggcctagcttttaatctatattttcagagggaagtaaggaagaagggtcaaaccccattaacaagtttctgaaagagcctaacttgcaatgtctagtcattccagagtaggatatttaccccaaggattaattcactgtagttgctgtgataaatgaccaaaccataaactgagtgactaaaaacaaagacctctaaatgattacacctggtatctttggaggagccattcaatctactatacgctgcttccaagtccttgtagaaaaacatacggaaatcatgcatcatcccatgggtggaagacctcgctccaggttagtgaactgctctgatttgtgactccaaagatggacattggtgacagcaaaaggaggacccagaatctcgtgtattcaaacagaactccactctcatgagaggtccttggatctagacccttgggtcaagcttcctctgagcattgtccaacatcttcccacttgctgagaaggaagattctttatgtgggccctggaatagcctcagtccagcctgatctctctctcttccctcctgaagttttatttcaaacattttgagactctaaaagggtttctttgtctcatttctctcctccagtcctactaccagggttgtcttcaatttatatccaatgtttctctggcctggaactgagacctacctcccaagcagcgacccgacccgtggagtggggtccctggggcaagcgaatggtcctttgcctggagaacctgggccagcagtcatggcaggtgacacattccattctggggcgaggaaccagggagggagcactgcatagatcagaagggtaaacaaggggagggagaaggagcaaacttagatttgggagggaaagagggaagggtgcagaggaagcagaacacggatgactgggcctccttcagttgttcttgtgactagaccctcccatctaagccaccaggggacaggaagggtatgagtttgaggactctaatggccccaaggtactactgtggtttatcctacttgtaggcggtcccaagagctttgttctctccagggactcaaaggggatgaacttgcaagtcttttgtctccactcagtgccttctctgattaggccaataaacatccccaggcctcagtctcaggccactgtaggggctgaggacagtgagaaagatgtgtgagcatccaccctttggagaggttgagtaggaatgagaggtcccctgccttgcctttggtccttgtgaaggaagatgttggatatttcccagcttggctggaatccgttcctcaccctccccattcagagcagggatgagtaagtcctccgctttctccgcaaccacaattgtgtttttcaggaaaggataaagtgggaaagatcagatcccatgcctcttcctcctctaagtcatgggatgactgcagagagtgagcaagagggtaaaaacagtgcactgagtgtgatgtttgctaaaggaacagataattgcatcaaaacctatttctagcagagttgtggtgcttgcctataatcccagctactaaggaggctgaggctggaggattgtgaggccgggagctcaagaccagcatgggtagcatagtgagagctcatctctaaaaaacaaaacaaaaaaccacacttatttctaattgtctaattggtatccactatcagacctttctgggaagttttttttctaacatgcctaaatgtggcttggagactgtttgggtgaggccaatagcttagccttcctacttaagttgtctccttcattcattcaacaagcaggtattattgagtggattgttgggtgcatttgtgtgtcctcagtaggatgcaggcatgcaatacatgaagatatgataattccagtcagaggaatggcctgtgcaaaggccctgaggtagagagaaccttgataattgaaagaacagaaagaaatccagtgggactggggaaagagaggaaggagatgagaggggagttacaggcagccaacagatcatgtgcagacagatcacttgaaagcagaggcaaatggctggatgtttttgttaatgaaaagagaatttatttgaagatcttccatcatttttacatgaagtgattgatgtgttaaatgaatgaaatttaacattcatggtgtatgaaatttatggaagaaaaactgaagcaggcagagcattttatggcctttgggcacaagagagtgaagcttgtcccatgtagagtcatggagagtgactgggagattcaccattagagttggcagattggctcttggattgaatatggggcatgaagcaaagagttgttgactcctggaagtttgactttgtcaatggcgtggctactactttcttttattaagagagagacagatgggagagcaacaggtttgagggaaacacataaagtgctttgtttggactcatggggattttttggagaagacagacaagatacaagtaacaagatgatgatgtctgtaatatttgggtacaaaatgcaattcataaacctgattgtataatatgatcctatttatgtaaaatcatatatatttagttaccttgattcaatttatacatcactaattgtttccagtaatattaaccaaaggtctactatatgccaaataaccttttatggctagagatagaaaaatgaacaaaacttactatgttcatccttatggaagatacataattcatatttgtaaacatcacatttaagtatggcaagaaatctggtgggatggttcctaaaatgaaacaatagtttcataggtttgtgagaatttaggtgatatttctacttaactttcatgtacactaaaaatttttcctataactcaaaaaaattttttggaggcagattagcaagatatttattttggaaaagcaagagtcaatctgaattgaactggagggatgctgagagttctagaacttcatagagagaaagaaaactgagttattgggtgggggttacacctatctttttgtcttttcttttctttctttcttttttttgagacagggtctccctctctcactcaggctgaagtgcagtggtatgatcttggctcactgcaacctctgcctccctagtagctgggaccaccacaggcatgcaccaccatgtccggctaatttttaaaatttttttggtagagacagagttttgccatgttgcccaggctggtctcagactcctggactcaagagatccgcccaccttggcctcccaaagtgctgggattacaggcgtgaaccactgcgttgggccgcttatcactttaatgtctaatgagaggcccctggagctggaacccttagccccagcctgacccctgacccttctcccatgtcctcaaattcaaaaactcacctctggctgtccattcagttgttctcaagtctgactgtgctctttgtccttcatgaactagaactagtctttctttcaaaccattttgatgagctgatcaatgtctcctcataccatttttctcattcagccttcctcctggggttggttttatttaccatctaacaatatttctgtaaccctgagcctctagagctgcctcaggtgcactaacgctgtgactaggctgccctgggacaagctaagaggttctgcgggggagggtctgggcccctggtgtggcagaaggtgcatccatcctggaggaagccagaggaccaagggccaggagcctgggggggattagaagggaccaggaggcctggtcctgagctgggatgggaaggaacgggaaggggcaggagcaggacagggatttccagatccactcagccgcctccctggggcttgggctcctccatctgaggccaccagggggcggcaagggcttggatttggggaagggaattgctgtggtttaaccagggagtgtatgaagctccatgggctgcttcctcctgagacccttctaagggagaagtggggagtggaatgtccaaaatatgttgtgtcccaatatgttcgtttctagaaaggctaataaatagcctcagcccccagcctcagagcactgcatagaaagaggacagaggtatttgagggtcattctgagagaacctagaaggtattgagtgggaataaacagtccccagctctgcctttggtccctgggaaacagagtgcctggatcactccacagtggtcatctgggatctggtccgaggtctcttccttgattctgttccctgagccttttttattctattttggatcagatccatgcacacgtagctcagagttgtgcccaagatttcataaggaatttacagggttttttccccctcaaacttatttctctccacagtctgcccattatttatggttccccagactttcccttttggtcttctggtgaaaaaactgtgactttaataagcctgcggtgctgtgcacttcctgcaactgagtccgtgtccacaccaaacaccaagaggacaaagagtaacaaaggtaaggggattaagtgccactgtcttggaaatcagctccaaagatgagaaaagaaagtccgcacagtctctactgtccctgctgtcaccacgaagaatttcctggaggctggatcatgtagaatggagagaagaacaaacataagaaaaggaaaacgtggacatttcaaatttgccctgagcactaggggtttcctttctcatcttcaagccagaacagtggagcttcttctggaacttttgtggctgcacactggtaccccttccaggtattggtctgccctgagtgcaggccacaggacactgggggaaaatgggaagctctctgctggtttgattttactaaaagtgctagtatctcccctagtctgcctccagtgatttgcttttccaagtaatcaaattgatgctccatggattctgtcccaggttttacagctgggcttggagaaaatgtggtatatgccactgcatccgaaatggaacctgaaaacagtaataatattctaaacgtgaaaattaaatcaatctgaatcacaggcagtggaaaacatcaaaagatgaaagagttttaaaagtgatttgaggaaagaaacagggagaaatattttcacattggttctatgtttactctatttatcttttttaatttaattttaaaaatagagatgaggaggtctcactatgttgcccagccaggctggtctcgaactcctgggctcaagcaattcacccgcctcagcctcccaaggtgatggattacaggcatgagccaccacacccggcccctgtgtttcttatgtgctccttgattaagaagagttgttttttgtttttgtttttgttttttgttttcttgagatggagtttcacttttgttgcccaggctggagtgcaatggtgcaatctcggctcactacaacctctgcctcccaggttcaagcgattctcctgcctcagcctcccaagtagctggattacaggcgtgcaccactacaccagctaattttttgtattcagtagagacggggtttcaccatcttggtcaggctggtctgaaactcttgacttcaggtgatccacctacctcggcctcccaaagtgctgtgattacaggggtgagccaccatgcccggccaaaaagttggtttattgtagcttgtggatacagtgagatggaagaaaacccagaaagcagaaataacacttctttgtaatatgaggaaaaaaataaaagataaagttgaatgaaatatttcatatatatatgtttcatatacatgtttcttatatatgtttcatatacatgtttcatatatatgtttcatatacatttcatatatatgtttcatatacatttcatatatatgtttcatatacatttcatatatatgtttcatatacatttcatatatatgtttcatatatatattgcaacatatatatgcaatattcatatatatagccatatatatgtttcatatatatattgcatatatatgtttcatatatgtttcatacatatgtttcatatatatatagttttttacagagtcttgctctcttgctctgtcacccaggctggagtgcagtggcctaatcttggctcactgcaacctctgcctcccgggttccagtgattctcctgcctcagtctcccgagtagctgggattacaggaacgcaccaccatgcctggctaatttttgtatttttagtaaaagtggagttttgccatgttggccagtctggtcttgaactcctgccctcaagcgatcctcctgcctcagtgtcccaaactgctgggataacaggcgtgagctatcacgctcggtctgaaatctttagataagtatgaagtctatataaaaaaaaaaggctcttactaggctagaaatggcccattttagaagctttcattttccacctcacactcatctctctatagatcctctgcttgggcagtgggtggaccttgtggtcctcagttctcaggctgagaaccagaggctgaaaaggacaagtcacctgctcatgagtgggaagggcaggattgggagcagcggactgtggctccattgctccttgtttcctccacaggcccctcccacgtgtgcccctgaatgacctagaatgactaatgtgctcaagggatttgatgctgcagatgcttcggcatgaagggtgggggtggggatgggacaaggctgcagctgaagagatgggagaccaacaacacacagcaggggtttccatggggtgggcacccccatttcctcacagtttagagagcctggaggtgggtgccaagcagagggcaccatggcgtggcccaggcctggaggttcacagagacacaggcacaacacagcagagacactgagggccaggagctcactcagatgagggacttcagcagatctttctctcttgaggaaattaggtacaaaggaatcaagttcctaccatcagaatagacaacaagttttaatctcctcagctgagccccgctgtcgagggaagcagaagtctctgagcccggcccaggtgagagtggggtgaggagaggagctcagggtgcagatttgcatgaaggccccaccctcctctgaggcagaggggataagacaagtctgggggtaggcccagcgctggggtctcaggaggcagcgctctctcgggacgtctccaccatggcctgggctctgctccttctcaccctcctcactcagggcacaggtgacgcctccagggaaggggccttggggacctctgggctgatctttggtctcctgctcctcagactcacctgggcccagcactgactcaccagagtgtatttctccctctttccagggtcctgggcccagtctgttctgactcagcctcgctcagtgtccaggtctcctggacagtaggttactatcttctgcactggaaccagcagtgacattgggggttatgaccttgtctcctggtgccagtagcacccaggcaaagcccccaaactcatgatttatgatgtcgctaattggccctcaggggcccctggttgcttctctggctccaagtctggcaacacggcctccctgaccatctctgggctccaggctgaggacgaggctgattattactgcagctcatatgcaggcagctacaatttccacagtggtccaagttcatgcgtaatgagaccaaaacctgccctggtctctcaggctctctctcgctatgaaggtgcttccttaccctgtgcagaagagggtttcatgcaacatggccttgagaatttcatccactctcagcccctctcccctccaacaatgaaatgcaaaagaaacatgctctctggttaattgtctagggacaatggcagcttcttcttttcctgtgtgatatggtcctgcatggtgactctttccaacttttcaatggcagggacagagcaataggatccatctgctcagtaccatttctgcagttttctatgaaaccctcacattaaatgcctccatctcccacactgtgctgactggcctgggtctgtgctccagaaataacgtcttactcaactccatatccaccacgctgtagtaaggatggctgtctttgctgggttatttgttcctctgcaggtctcttcccaaagcaacaccaactgagagaagatctgaagatgttgagagagtgagcataaaagtaaagggttttatttatttgctttcttttttttttaactttgtttttatttatttttttgatacagagttttgctcttgttgcccaggctggagtgcaatggtgcaatctcagctcactgcaccctctgcctcccgggttcaagcgattctcctgcctcagcctcctgagtagctgggactacaggcacgcgccaccatgcccagctaatgtagagatggggtttcaccatgttggcctggctggtcttgaactcctggcctcaggtgatctgcccacctcagcctcccgaagtgctggcattacagacatgagctaccatgcctggccttgtttttattttttagagttcctttgtctttgacccgatgtctatctatgggggcttagccagggcacatttgagtgattgttctttgcgagaacattgttctttgcagatcattaaacccctgtcctggaaacagtcctgtacttagactgtctccctgttagcatgggctctttcctaaatgatccacaggaaagcttatttggtggatgggtcttctgttcctcaaggactctatgggtagtttattttcaaggtgagccaatactgtttctagctggaatctcatttaatctcataaccatgagaattaattttttaaacctgcagggtgttctctagccattttttaattttctttgattttgtgagccacttttaaattataatcatcattaaaccttaaaacatataaacttcaattaagcagattatatattttattttattttttgagacagagtctcggtctgttgcccaggctggagtgcagtggcacaatcttggctcgctgcaaactctgactcccgggttcaagtgattttcgtgcctcagcctcccgagtagctggaattacaggcatgtgccatcacgcctagctaatttttgcatttttagtagagacggggtttcaccgtgttggccaggctggtctcgaacttctgacctcgtgatccacccgcctcggtctcccgaagtgctgggattacaggcatgagccatcaagaccagccacatatttttaaaaagtacattggttattatccacatacctttggactgctataacacaataccttaaactggtggcttataaaaacagaaatgtatttcttacactcgtggaggctgggaagtcttaagatcaatgtgctggcagatttggtgtctaatgactgtctgcttcctcatagaggccattttctcactgtgtccttggaactgaggacaaagcagctcctggtaaagttcagatgtctgtttcttgcaggaaaatttctctttacagtgatctgggctactggctccaacacacgcacccagatggatttctgagccggtcattgaccattaccattttaatattatctcaaattataaacattatctcaactattgtttaatataatatagcacataaatgtttaaagcatacatagcgaaacaagggtcttacattcaaaactgtcatttccccaatcacccatctccttgtccaccaagccccagtgccaccacttagctcattgctcctttggcttcactttctggtgctcttgcaagtgtctgtcatgtgttacaaacaacaacaaatagtcctccaagaacgtttacctccatagaatccctatcctgtttcctgagtggacatttccatttttaatctggcaaagatcagtcagccctgattagtgttttaaactcatatccatctctttctagaaaaacacactaggttaagcatctctctgtggatgggggaccctcatgaaggcacacagctctgagctgaggtggcctcaatgtgtacaatggagcaagacaaagaaaagtcccatgttctgtgtgatagacagacaggcactgatgagaggtctccagagctggcgcccttagtctaatcttgactctagtcctcgtctttccgacccttaaacactagaattcctggtctgcattccattaggtcattcttaaatctagtgagctgtatctccttcatgcaatgtttttctttcactattattttcagctttattgacatataattgacaaataaaaattctatatatttatggtatacaacttgatatattaatacatttgttgtacattgatatatttgttgtgaaattactgcaataattgtgtgaaatcacaatcaatctaattcacataaaataaccttacataattatcatcttctttcttttttttttttttttggtgagaacacttacaatctaccaaattagcaaatttaaagtaaataatgcaatattgttaaccatagtcacattgcggtacattagctatctagaacttattcatcttgtatcactgtactcttttataccctttgataaacatctccccatttcccttttccctccccagtcctgacacccaccattttactctctggttctatgagtttgaatattttagattctacatgcaaataagatcatgcagtatttgcctttctgtttctggcttatatcagttaacataatgtcctccagctttatccatgttgttgcaaatgatgggatttcctttattttttaaaacttggcaatatttgtgtgtgtgtatgtgtgtgtatgtatgtatgtatgtgtgtgcatgcaccacattttctttatccattcatttgtcatcagaaatttaggttgtttccatgtgttggctattgtgaataatgttgcaaaagacatgggagaacagatatctattcaagattctgatttcattttgttttgagatatgcccagaattggtattgctggattatatggtagttctatttttaattttttaaggaatccccatacattttctacaatggctgtttagtttacattcctttcaacagtgtacaagagtttcttttgtccacatccttgccaacatttgttatcgtttatctttttgataaattacaggcacgtgccaacacacctggctaattttttatatttttggtagagacggggtttcaccatgttggccaggctggtttagaactcctgacctcaagtgatccactgcctcggcctctcaaagtgccgggattacaggtgtgagccaccatgcctggcctattttttctatttctataaagaatgacatttgtgtattgataggtctagcattgaatctggagatcactttaggtagtatgaacatttaagaatattagttcttccaatttataaacacgagatgtcttgatatttatctgtatcttctttaacattcttcatcactgttttataatttccagtgtaaaactctttcacctccttcgttaagtttattcctaagtactaattccttttgtaaatgtgattgctttcttaattttattttcatatatttactgtctgtgtgtagaaacgtcatcaatttttgtatgttgatttttttatccttcaaatttacttaatttagttttaacagactttttgttattgtggagtctttaggtttttctacacttatgtttatgtcatctgcacacaaagattaggattttaatccttcttttccaatttggatgcgtttcatttctttttcttgtcgaatttctctggttagggattccagtgcaatgttgaattaaaataagtggagagggggcatcttgccttgtgtgggatcttaggggaaaagcttctgtttttttcccattgattatgatgttagttgtgggcttttcacatatggtttttattgtgttgtggtaagtttcttctgtacctatttcattttatttttgtttttttaaatatttattttataatagagattaattttgctatgttgcccaggctggtcttgaactcttgggctcaagcgatcctcctgccttagcctctcaaaatactgggactacaggcatgagccactgtgcccggcctatcactattttgttgagagttcttttcttttcttttccttttttttccattgctttcttttcttttcctttccttttttcctttccttccttttcttttcctttcttttctcctcctcctcctcttcctcttcttttttctttcctcctcctcctccttcttcatcttcatttaaaatcatgaatggatgttgaatttggccacatgccttttgtacatctgtggacataatcatatgtgtgtgtgtgtgtgtgtgtgaatctttcagcctgtggatgcgctataccatccttgcacatgcggaatcatccttttatccagggataaaccccacctgttcctgatgtatgatcttcttaacatactgttgaatttggtttgctagtattttactgagaatttttgcatttaatatctgttaatgtttatcagaggtagactggcttgcagttttttttcttttctggtgttgtctttgctttgttttggtatcagggtgatcccgacctcataaaacaattttggaagtgttcccttttctattttttggaagactttaagaagaattaatattaactcatctttgaatgtttggtagaacattcagctatgaagccatctggtcctgggcttttctttgttgagatatttttgattattgagtcaatctccttctttgttattggtatgttcaggctttgtattttttattgatttgcttttttttttaagttgactgtttctaggaatttatttatgtcttttaatttatctagcttggtgtataatttttcaaaatagtcccttatgatcctatttatttatttgagacagggtctttctctgtcacccaggctagagtggagaggcttgaccacagctcactgcagccacaacctcccaggctcaagtaatcctcccacctcagctttctgagtagctgggactacaggcatgcaccaccatgcctggataatttctttttctttctttctttcctttctttcctttctttcctttctttcctttctttcctttctttcctttctttcctttctttcctttctttcctttcctttctttctttctttctttctttctttctttctttctttctttctttctttctttctttctttctttctttctttctttctttctttctttctttctttctttctttcttttcttcttttttttgtatagatgtgacctcactgtgttgcccaggctggtcttgaattcctgggctccagagatccacctgcctcggtctcccaagtgttgggattacaggtgtgagcctttttatttctgagaaatctgttgtaatagctccttttttcattttggattttatttgagtcttctctcttttttcacagtgtagctaaggatttgtcaacttcgtttaatttttcagaaaaccatctcttagttttgtttttttctattatctgtttgatttatttctgctgtaatctttattatttcatttttttctgctaagtttgggcttagtttgttcctctttttctagttcgttgagttataattttaggttgcttatttgagatctttcttcttttttaatgtttgcttatctccataaacttcccacttagcactgcttttactgcatcctataggtttggtgtgctgtgttttaattttcatttgaagatatttttaaaattccctttggttttcctctttgacccaatgcttgttcaacatgtgatgtttgatttctgcctatttgtgaatttttccatttttttttactgttattaatttccagattcatttcttgttgtaaaaaaagatttttggaatgatttaattctccttacatttcttaagacttgttttgtgaccaaacatgagctctctcctggagaatataccctgtgcatgtaagaagacattttgagaacccaggtggtcttttctcataccatttttctcacccagtgctcatactgaggttagttcattttacatctaacattttctcagcctggagctaagacacctcatgtacctttgacaaagccattctagcacaagcaaaacggtcctgagaacgagtatcttagccacctggtatggcagaggacacattcatcatggaaaaagtctgaggaaaagggtcaagattagcatggatcgagggtctggtcctgagctgggaggagaaaaaggcaggttggagtgggaccaaaccaggtatttctatctctcacttagaattgtgtcttggtacttgagatgaaccatctgaggccaccagggggcagcaggggactaggttggagaagatgattgataaagtttatcctgacctttaagaagcccctgagtcggccgggcgcggtggctcacacctgtaatcccagcactttgggagactgaggagggtggatcataaggtcagaagatcgagaccatcctggccaacgtggtgaaaccccgtctctactaaaaatacaaaaattagctgggcgtggtggcttatgcctgtaatctcagctagtcgcgaacctgaggcaggagaactgcttgaaccagggagttggaggttgcagtgagccgagatggcgccaccgtgttccagcctggtgacagcgcgagactccatctcaaaaaaaaaaaagtccctgaatctcaaaaaaaagaatgtgactttatgattaactatgaacagctgctcattaataaaaagccattaaaaaaaaaaaagaaatcccaagagctacttacccttgaatatctctaaaggtactgggaagcagtgctccaaatctgttgtggcccagtgaattcctttttagaagcaccattaatggtcctagttcaacatgtcaggccccagctttaaaccactgcaggggcaggggatgtagcagtgcttagaacccaccttagctgagaggaccaagatggttgggcaggggatgagggaaatgagaagttccagcactgtctgaagtctctgggaggaggagtgattgaactttcccacccggcctgggagcagcctgtcctcacattcatccctcacagcacaaaggagaagtcctggtttcctcagcctggagctcctgcaatagtgagggttaggatatctctggactggcctgatgtcctgggcactctcatgggttcagtctcaggaaatccatgcctaggctggattaataccctcagctgagcctcacagggaagcagaagtctctgagcccaggcccaggtgagggtggggtgaggagaggagctcaggacacagatttgcatggaggccctgccctcctctgaggcggggggataagacagggctagaggcaggcccggtgctggggtctcaaggcagcgctctcgggacatctccaccatggcctgggctctgctcctcctcaccctcctcactcagggcacaggtgacacctccagggaaatggccttggggacctctgagctaatgcttggtcttctgctcctgctcctcagggtcactggacccagtactgacccagtagagtgtgtttctccctctttccagggtcctgggcccaatctgccctgactcagcctccttttgtgtccggggctcctggacagtcggtcaccatctcctgcactggaaccagcagtgacgttggggattatgatcatgtcttctggtaccaaaagcgtctcagcactacctccagactcctgatttacaatgtcaatactcggccttcagggatctctgacctcttctcaggctccaagtctggcaacatggcttccctgaccatctctgggctcaagtccgaggttgaggctaattatcactgcagcttatattcaagtagttacactttccatagtggtccaagttcctagggaactgagaccaaaacctgccctgggctctcaggctctgtctttgctctgaagatgcttcctcaccctgtgccaggggcttcctgcaacagggccttgagaattcacttctctgtcagctcctctccttttccatcaattcccaaaggaaacctcctctcttgtttactctccgggatatgacagcttcttcttcactcgtatgacggatgtcctctctgaattggaaactacttctagctctttaacaggaagtacataccggcagggaaatgcctgcctagtgcagtccccatacttctccggatgatcctcactttattatttatttttatttttgtatgcactaaagtcgtcaatgtaaatccttacgtcgaatgcctccacttcccacattgtgtagcacagcctggattcagttcttcagaaatgacgtcctcttcaatgataaaggaccactgctctgtgaacaccccactctagtgaagatagcccaccttgctgggttattcatgtacatcttttgtggaagcagtaaccactgtgtaaagctccaaagatgttttaaagcaatgaaaacaaagaggaagaagtgtgtgtgtgtgtgtgtgtgtgtgtgtgtgtgtgtgtgtgtgtagggtccatcctgtttgccctaatatctcaggttgccgagctagggagtatttgagtgacagacttggtgccctctcaggatcctcctcctctcacatcactgagtccctgtcctggaaacaccctacaggtggacaatctccccatagtatggaagtttccaaaatggctccacagggaagagttgagctgaacacacccactctttctcatgggcatcaaatatatctaatttttctggggaaatcatcaatttctagctggaatcctgattaatcgacagactgtgagaattaaaaattttaaaaatattcagacatatccagagtccagtatttaaattctctggaattttgtgagccaatctttaaacatagttattattgtagtttagagttcatgaacctgaattaaatagattctagtaaacataaagtgccttagttgtctattgttgcataaaaattactcctaaaattaacatattcttaatgagaacacatatgcattaatctgttttcgcactgctataaagaaataccttatttataaaagaaagaggtttaactggctcacagttccacatggctggggaggcctcaggaaacttacaatcatggtagaaggcaaaggagaagcaagaactttgttcacaaggtggcaggtgagaagagctggggagggtgaacttccaaatacttttttttttgagatggagtctcactctgttgcccaggctagagtgcagtggcgtgctctcggctcactgcagcttctgcctcccaggttcaagtgatcctcctacctcagtctccgagtagctgttattacaggcatgcgtcaccaagaccgactaatttttatatttttagtagagatggggttttaccatgttgaccaggctggtctcgaactcctgacctcaagtgatttgcacacctaggcctcccaaggtgctgggattacaggcgcaagccattgtgcctggccccagacacttttaaaaccatcagctctcatggtaactccctacccatcacgagaacagcaaggggaaaactgcccccatgatccaatcccttccgtccctcaacatatggggattacaagtccctccttcaacacatggggattacaatttgagaagagatttgggtggagacacagagccaaaccatattaatgtatttgtgatcttgtagttttcttgcatcaagaatctgagagctgcttagtttggtggttctgactctgggctcctcatgaaattgcagccaagctgtcaggcggggctgcattcagaggccagagcaggtggccaggcccagcctgagggggcttctactgtccctaacctctttggcagatgtagatgaagtcagggaaaaggggagctccccacagtgggtagcatcccagtgtcagagggaaggcaccatggagcagtgggaccagcacaggaccctgggggtgcactcagacctacctggagggatggcaagaaggggcattcacagcagggacaggataaagggcctctgccccatgtccagagctgtcttggcagctcagtcacattggttatcaggtaaatcggaggtaaaccctatcctgagttttaccactgaaaatgggtacaatttgaactaggagtgttttcagactttttctttccatattgacttcttaataaccgcgatttaattttttttaaccccagcctagtttagctacatagcttccaaatgtcatgctactgtgaaactgagcaattagttacttttatcagagcattttaaatttgaacaggttccttggtctttctatgtgtaattagtcaaagcttaggtatggagtagaggatctttaccaaatgcttttctagactctgttttcattggacttatagcagctgtttcacctgggccatgcaggaataggagagttgttgctccttgacatagcatctgtaacatgcctatcctttctgccactataaaaatagctgtgctttctctccactcgtctctcctgctgtttccctgtttttcctattaaatatgcagtgtttgcaatccatcttgcattctgagaagatgaggattttttttcataaagaatgacctaaaatagctctaaagatcatcagaagtcacaactacatacttactggagtgcaataccaaatgtggcctctgattacagtaacctggagcttgcagtttaagcaattcagtccctgtcacttgtggacagattcgtatgtctgtggatgagaagatgagcaacggtcactcctgtgctcatgcacagatccctccctgcccctgtcctcaaattcagactgaagtgcatggccctggagcattacatgagtgatggtttaagagcacgttggtgatacacacaatattaatggtatcttaatttgcttgttaagcataatttgaaaacatctggacaaatttggacacaatttgaagggcatatttgataatagcttgtgacaaatgattccgttctgggagagatgctatttttggttctctaaatcgccatgaaatgaaaatctcagattataaagaaatagactcaaatcccaagtgtcttttgcttttcattccccatcaactgtgttgcccaagcaccatgtggacactgcttacagggtaggcagccaccagctgaaggcaggttctttagttgtctgagctgtcctggagctgggaacagcagcgtgtgttctgtgcctgttggtccctatgtagcacacacccactgcatattctcgctgactcaccaggagggcttgcagcagccctggcctattttcttctgaagcacctgccaatggtgcattctcccctggtcataatgcaccaggagataaacatggcatttgacacacaggtgctaactggatctaggacttctaagcttaagtagactcagagtgggcaatctaaaaaaaaaaaaaaaaataggttctcaatcggtagcccaggctggagtgcagtggctccatctcctacctcagcctcctgagttgctgggacaacaggtgtgtgccaccatgcccagccaacagagagggcaatatggacttgaaatggacaatttccattacttgaaagtttttgagaaagaactgaggtttgtttaagaggaaatcagccagagactcaaagttaaatctatcaggcccaaagtctctttggggaaaggagactcttggacgtgcacgcagcagcaagtggtatgggatcccttctctgtggggaccttggcccaactgccaatcttttcaactgacccatttgcgttttccataagtgctcgccagccagcagctgtgactgcccctcagtctcaggaagggagaaagaaggaaacaggagcaaagcctctttcaatcttagcaaataaagtgggagctttgacttttttgaacacccagatgacaggaaagaggaggaaaattttcctaaagctgttattttttaatgcctcaggaagaatcacacccggagtctcatccacactttatttggaggtatttgggtctcagagtttgtgctgagttagttaatgatttgggctactgggatggggtgaatgtgttttacaagtgagaaagaaataagctttggagtccacagggtggaggcttattggctaaattgtgtccctcaagattcatgcaatgaagccttaatcacagtgtgtgactaaatttggagacagggtctttatggaggtgattaagtgaaaatgaggtcatgagggtgggttcttatccagtctgactggtgttctccttagaagagaaaatttgcacacacagaaatcagacaccagagatgagcaggcggaggaaagaccatgtgaggtcacagcaaggaggtaacgacctgcaagccaaggagagaggcctcagggaaaatcagtcctaccaacactttcaccctggactttccagcttcagcactgagaaaataagttttgctgttgaggccactagttctttggtatcttgtgatggcagcactggcaaatgaaaacaagagggaccccaaagaccttgggtagggggaacagatggagcagggtgcaggaggcagggcagggaggggctggaaggtcatgctctgaggttcgtttcctggatggaactgggactccactcactactgtctggggaacttggggaaaaaacttcacctcccaatattgattccctaataaaatctgggccctgagcatagggctcctcatcttcctactccatatgatgcaagttttcttgaagttatgcttgtaaaacactcaccaatgcatctggcatatattaagggctcaaaagtaggccaggcatggtggcttatgcctgtaatcccaatactttgggaggccgaggtgggggatcactggagtccaggagttccagaccagccaggccaacatggtgaaactccatctctactaaaaatacaaaaaaaaaaaaaaatagctaggcatggtggtgcccttctgtaatctcagctattcaggaggctgaggcaggggaatagcttgagcctgagaggcggaggttgcggtgagcccagatggtgccattgcactccagcctagatgatagagtgagactccatcacaaaaaggaaaaaaaaaaggttgtcattctgcagcccagatcgtgccattgcactccagcctggacgatagagtgagactccaccacacacacacacaaacgcacacacacacaaaaactaacccccgccccgcaaaaatcgaaggtagccattctgctgtatgatctattgatacatacaggatgacatttgtcctgtgggcaccagggggcactgtgacccctggtttgggacactaatggctccaagtccctggtagtacttgagtcatttcctttctggccccttctattgagtggaatcctgaaacccacctgactcttctactcttgaaaaattacgcagagaatgtcctcagacatagggtcagacaagaacttcgacatacattttaaagaatggagagcagatttacatccgctgcttaacagggaaccaactaacaaagaattaagaataaaggaagtagagttgcatgaagagactcccctttctatgataagaaaggcctgaaggtcccttcccagctgtggactcagaggcagagctctggggcatttccattatggcctggacccctcccctgctcgtcctcactctctgcacaggtgctgcctcccagggctcagcccccagtgggatcaagatcagcctggccctgaccttcaactcaacatagggagtgatgcagggtgtggggttctgggaatgaggccctcatcctcagactcacctctcctgtcctctcttgtgggctccgttatttcctctgggccaactcaggtgcctgcagtgtctgtggccttgggacaaatggccaggatcacctgccagggagacagcatggaaggctcttatgaacactggtaccagcagaagccaggccaggcccccgtgctggtcatctatgatagcagtgaccggccctcaaggatccctgagcgattctctggctccaaatcaggcaacacaaccaccctgaccatcactggggcccaggctgaggatgaggctgattattactatcagttgatagacaaccatgctactcaactcacagtgacacaggcagatggaaaagtgagacacaaaccctttttctgtctgtgtcactcacttcctccggccccagcaggactgtggacacagccatgggcaggtctggctcagttttcctggatctgagaccccagggtgccctgacctccaagccctccagggagactctgaagagagtgggttaggtcaggagaggacttggggctggcaggaccagactgtcctggtattgtccagagtggctgtgtcttggcttaagatgacctgagtgtaaggatagtcagagggagacagccattgagtggtaatggtccctggatttccttctgtatggtgactggacctaaggcagtgctgcttttctgtggcccaaatgccccagatcattctgaacttctcaggtttaactgagaccctcaagccccagctccatgacatcctcatattctgaacagggagggccaccacaatgggcagtgtggtgtccatcaagattcccctttcagggctcacccatccgccatacacccaaagctgccgggaggccctggcttctcacagctgctccccaccggaaaatgccattgattgcaaagaatggcctcccccaaaagtttgcccatgtcagagcgtggctcaggtgcaatgactgcttgatgcctcaatcccaaagtcaggccttaatttaggatggccttgaagtgtgttgcagctgagcactcaattgtaacacattcccactcatgcctcccatacttctttcctgagaatatatccctaaacctcactgcatggaattccccctctcagagtaggagtctggggaattaaaagatttaaaaacaaaccaaaacagtccaaagggaagagtaacaaagaggagagagttgcacagagagaggactctggagtctgcaaatgttcgtgagcaccgatgagcacatatgtgggaggaaacaacctctggaagagaaaagaaccatccaaagacacttgagagaacactccagagcgtgtgtgcacgcacacacacacacactcacaccccacataaagaaaacaacaacactcatcatcatcaaattgctaaaaaacattttagcaattttatgctaaaatgatgatgaagaaatgtggtgaagaaatgtagccttaaaagtagccagagagacgaggtggctcacgcctgtaatccaagcactttgggaggtcgaggcaggtggatcacctgaggtcaggagtttgagaccaggctggccaacatgatgaaaccccgtctgtactaaaaatacaaaaaagttagccggatgtggtggcaagcgtctataatcccagctactcgggaggctgaggcagggagaattgcttgaacctgagaggttgcagtgagctgagatcgcaccactgcattccagcctgggcaacagagcaagactcaatctcaaaaaaaaaaaaaaaaaaaaagtcagaggcaaaagacatgttagatacaggtgaacacaatgacaagagcagaatttttattagaagcaatgcaagcaggaagtagtggagctatatttataaaatatgaaaagaaaaaacttataacccagagcaatctacagcctcactgaaatccctaccaaaataccaatgacatacctcacagaaatagaagaaaaaccccacaattctacaatttgtatggagccacaaaagacccagtatagccaaaatgacactgagcaaaaaacaaaactggaggcatcacattacctaattcaaaatatgctacaaacggccgggcgcggtggctcacgcctgtaatcccagcactttgggaggctgaggcgggcggatcacgaggtcaggagatcgagaccatcttggctaacacggtgaaaccccatctctactaaaaatacaaaaaattagttgggcgtggtggcgggctcctgtggtcccagttactctggaggctgaggcagaagaacggcgtgaacccgggaggcggagctggcagcgagccaagatcgcgccactgcactccagcctgggtgagagagcaagactccgtctcgaagaaaaaataaataaataaaataataggccatatgtgatggctcacacctgtaatcccagcagttaggaggccaaggtgggaggattgcttgagcacaggagtttgagaccaccttgggcaatataatgaaaccctcatctccacaaatttttttttttaaattagccagccttggtggagtgagcctgtggtcccagttacttgggaggctgaagtgggaggatcacttgagcccaggaggtggaggttgcagtgagtcatgatcttaccactgcactctagcctgggcaacagagaaagacactgcttcaaaagcaagcaaacaaccaaaaaatcaagtaatatcattgaaaagggggcaaaggatcagaatagacttttctcaaaagaagataaacaggtggccaacaagcatatgaaaaaatgctcaacgtcactaatcatcaggtgaatgcaaatcaaagccacaacgagacatcatcttaccccagctggaaaggctatcattaaaaagacaaaaaaataacaagtgctggtgaagatgcagacaaaacagaagacaaaaaccacgtgatcatctcaacagtcacatcaaatgttttcatgtagggaaacattactgtttgtgattttccagacttgctagagcatcataaaaagtaagatttgtggtgccgatattggagggggtgttattctgtgcaaaaaacctggatatcccatatccaactgtgaagatacttactgataaatgctaaaaaattgcaatattgtgtgtccaaatgttctgggggtcaggagtggggtctcacacgggaaaggattcagtcaaagagaaaaatagagaggctagaacatagaggaaaacataatatgtctggaaataaggagtccaaactaattggagctgagtgataacaaaagaacaatggcatgaaccatctatttctctctggaaatctcattgatatattgtgctctctccagggctatgcccagctagattataaaattgtctgttcctgaaacgtttcttgcgtatatgacagggcctaacactggaatcaagctcaggttgatgagggcagggcagttaagcacccgaccctggtggcctgtgaaatacttgggggagacaggggtttgttgtctaaagcagaggaagtgagattttccactgtggcttagaccagagcttctgaaattccagtgagcaaacaaatcccctgtggagtctgtttaagatgcagatgcagcctcagcaggtctgcgtggggccccagagtctctatgtccagcagctcccaggtgaggctcatgctgcttgtcctccaagaaccacactttgagtggcttaactcctattcgccctcctcactcaagcacaggtgagactctgccaaggaaggcactgtctgagaagcaaaggtgaccttctgtccttcctcccctggtgttttagtccatgttctattgccataaaggaatatctgaggcagagaaatttataaattttaagaaagatttctttggctgaagcttctgatggccggaagttcaagagtgggcatctgcatctgttgagggcctcaggttgcttccactcatggcagaagatgaaggggagccagtgcgtacagagaccaatgggagagaggaagcaagtcttttcctaacaagaatgcagggatgtaatttaatcatatttataaagtgtttgacatagagcctgacacacccaggtactcctagttggcagcaattattactgtcgtcgcacatgaaaattggacctgggatggaggaaaggcagcgcaaaccctctgtttgggacaagagagacttaaataatttaaaattgaggcataggagataaggagagtatccctgggtgttctcctgccaattctctcagcatctcggaaactgtttcaaggtgatgaagtcaaccagagagggaagcggaggagtttgtagaaccaagggttgcaacttcatccatgaggaggaggtgtagtcaggggattgggaagaggtggctgagctcatctgaagggtgtctaaggttttctggcccccatgtcctggcccatccctccctgcccagggtctcacccctcacctgacagcccagagctggagagtggcctatgattctgattagagaccccaccaaagcccagaggggaagacatgggtgggaggcgtcacagaagacagttttctgcctgtggtgttggggcagtttcctggaaaggaaattcagacactgtaggggagaagaaaacacaggagaggaaggcccctccccaggggattgtggcgttagagaccaaagcatcttcaagaagcccagccctgcaggaggttccctgagcccagagttcctagagctgtctgtattattttgcctggggtgccataaaaagtaacacagactacatgactcaaagaacagaaatttattgtctcactaatcttatggcgatggtagaatctgagatcaaggtgttggcagggttggctccttctgaggctgagggagggtctgtttcatgcctctcccctggcttttggtggtgtagcagtattagctgttccctggcttataggtgaatcaccccaatctctgcctccatgttcatatgacgttttctctctgttcatgtcggtgtccaagttttttctttttataaaaagaccagtcctattggatttggggctcactctattccagtatgacccgatgttaactaatcacatctgcaaccacccttttcctatgtaagttcccattctgaggtcctgatggatagcacttcaccatatgaattccagggggcacaaaattcaaattcccaacaatgggccaggcacggtggctctttgggaggatcccaaatcccagcactttgggaggccaaggtgggcggatcacatgaggtcaagagttcaagatcagcctggccaactggtgaaaccctgtctctagtaaaaatacaaaaattagctgggcgtggtggtgcgtgcctgtagtcccagctactcgggaggctgaggcaggagaatcgcttgaacctgggaggtagaggttgcagtgagccaagatcgttccactgcactctagcctgagcgatagagtgagacttcatctcaaaacaaaaaacgaattcccaacaatgcctcagacatggcttaagctgcccactggggctctgcaggtgggatgtgcaccaccaagctctcaggtggggcattacctgacagcccagaaggactccgggccctctgcaaagtgcctgatctcttgcgcaccttaaaaggtagcttttcaggctgttcttgttcttttcatgctgacgtaggagattttatcctctgctttttaagtagaagcttccttaccctcctcatcatcctgagtagatgcctaggctggtttcagagaaatcaaaccagggtggattatgagttatattagccaccagctgtcaatattctctgaatgcccagcatccatccatgctctctgaccatcaccagagtgagcaaatctctgacatgtggataagagtttcttccatgggctcccagccaggctgtaagtgagaccagaatacccttccttcagtgcatggggctcagtgcagctgcctccctgacagtctccctgggacattaagcttgtcagcttctctcttccaaatgcaggtctggttgtcctaagcccagctcagcgctgctgtggactttgcatcctaaaaacattatcaactctgccttgtgcctcagtggactggcctggaggaaacaatatgaggtgtcctggctctttccacccccagcgtctctctccctcagtggtaccagtacggtcctcatgacggttcatctatacctgccaatctaggcctccacactgccgactgtggatggtcacagaacccaaaatgctaatcagccttaagcagatcatgctaatagtttctgcagatctgggtgcctcatcccagatctaggagttcacaagctaggccagctccagggagataacatgtatcacagagtctggacacgacaaagtggctttgctgtatttttgctgggacacatgatggtgatatcaataagaactggctcaggtccctgcagcttaaggcccattgaacaggaaagcagccaggaggatgtgctgccttttgacctgtacacaaatcagtgccatgtgccgactgtgtgtgaatatctgtgcctgtgtgtatatttgtgtacatgtgtgtatgtatgtgtacgtgtccaagttggtgttgcaaggaagtgttcctactgtcaaatgtttcaaactcaaatcttttctgttttcctaacttacctgcttcttctatctctagtgcctttgttctgcactaagaataaggatgaagattagggtagtaatactagcaggaggagtaaagattcatatgtgtttaatacatatcaagcagtcttccaagtacttcatatttattaattcccttcatctcaacaactctatgagttgttcattatccctccgttttacagttgggaaatctatgatacatagattttgagaaatgggaaaactaatgcagagaaaagaagaataacatgcctgatgtcagaactagaaagtggctgacccaggagtagaatctcaggtcttctggccccagaaaacctgttcttaggcaccatcctgtcgcctgtcattgcatcaatgtggtaaggcattggtgtgtctttaaggctccagaaagttctttctactttgtatttattttgttttgtttttgagacagagtcttactctgtcacccaggctggagtgcagtggcaccatcacaggtcactaaagtctcaaccttctgggctgaagagatcctctcatctcagcctcctgagtagctgggactacaggtgaatactaccatgcccagataattttaaagtttttttgtacagatggggtctcactatgttgcgtaggctgttctcaaactcctgggctcaaccaatcttcctgcctgagcctcccaaagttctgcaattataggcatgagccactgtgcccaacctttactttttaaaagtatcatattgtgactttgagtgcaccagcagtgctctagtgctggtctattagaaatgtaattttaagaatatatatatataatatacaattttttagtggccacatttaaaaggtaaaagaaacaggtggaatttatgttcataatatattgtgtttaaatgatttatccaaaatattatttcagcatgcattcagtattaaaatattgagatatttattttatttttgtactaattctttgaaatctggtgtgttttactcctacagcacatcttacctcagactacccatgtttccagggctcagtagctccctgggactcatggccgccatattggacacagcaagtccagatggataaaggtccatttgggtcacagcccctgcagtacatactgacagctacctgggaagaatggagagttccatgacccaaagggcctcctgagggaggaatggcagctctactttccagccaaagcaggaatattgagggcactaagaaacaagggaatttttacagtgtgtttcacacttcttcccttctcaaagacattaaatataacttcaattttaaaggtgaacctcggccatcaaaggcatgttttctattggtctctttccggtggaatgaatggcaatggtccctgtaaattgtgctccaaggatccctttcagtgggaagattcttgtgataagcccaataacaagtaagaaagcaattttttatacatagatctagaacaaaaagggctcatgatgaagaatattttattgaagcttagtgtattgctatttttcataaattgctgtttttgcctatcccacaagcactgatcacttttatgaaggtacattctccaagggtcgtcttagcatgtcaggacccacaagcaaaggtgttacaagtgacctgcacgagtggccagcaggacacctggaggagcccagtgagatgaggagtggatgcgcatcaggtgggaaggcatggagaagctgtgtgccacacactcaccaaggacaggagcgggcgtatttgtggcctgtggcctaatcttaggtcagttacctctttagactaaatcccaaggagtcagcacatggaggtttcggtccgtgcacatggcacctacagggcttcacatgacgttgctaattacaatgcagcggcacttacaaaggaattagtttcatcacatcctcagcagaactaggtctaaaaaccaatatatatgtataggatatcaggtgagaaatactttcttgccaatcatgtgtattaacgttaaagtggttcagtatctagtgtgacagttgttcaggcttagtggccttgaccacgtcaaaaatggaatcctgatcctaacttgtctagagattagcctggcacaaggagcatgaccaggcatctggatgtccccagtgtcactgcagacacatgctcctttttcatctgccagagggagcattaggatgtcctcacctctgtccccagaactcaggaagggcagtacacctgactaaagagtagagggttgtgaaaagagggacctagggcactggataagcaggaggagaaggagcactgggtgggaggtagagaaaggagggggctgaatggttaggctctgaggtgtgtctcctggatggagtcttggattccactcactaccatctgagaactttgagaaaaccgtgtaacctcctgatgttgggtctcttgtcagtagacatcagtgctttcctgatgtatagggttactgtagaattataatgaatgcctggttgaggtgacatgtctaatacaccctccaaagcatcaggcatatattaagtactcataagcaggcattctgtgtgaactagtcatacatggaagatgacattccccgtgtgggcacagtaggatgctgtggactttggtttggggaccctaataacttcaagtcccctggtagcacccaagtgtaaaaggcaaagggcatgactggtgcttcctgtgaggcctcttctatttggtaaaattcactctccactcatcgcacccacctggcctttattctaaacttggaaaattgctaacatgaaggtctcagcctcagggctcagataagaactcagacacatcaatagagaggatggctgaggtgcttggccgagctcagtgaacaccccagaacaggaactgaggagtgtatgcatgtgttgggggcagcactttctcactcatccagaaagtgtgaggaatctgtacagaactggggacagggcccatttttatacccttctataagcccagcccttgtctgctcactagggagccattcaccaaggccacaggagggaaggaagtagatttgcatgaagagcatccccttcctatgttaagagaggcctggaggccccttcccagctgtggactcagaggcagagctctggggcatctccaccatggcctggacccctcccctgctcaccctcctcactctctgcacaggtgctgcctcctagggctcagcccccacaggaccaagaatcagcctggccctgacattcagctcagcacagggagtaatgcagggtgtggggctctggaaatgagacccttatcttcagactcacctcttctctcttctcttgcaggctccgtggtttcctctgagctgagtcaggagcctgcagtgtctgtggccttgggatagacagccaggatcacctgccagggagacagcatagaagactccgttgtaaactggtacaagcagaagccaagccaggcccctgggctggtcatctaacttaacagtgtccagtcttcagggattcctaagaaattctctggctccagctcagggaacatggccaccctgaccatcactgggattcaggttgaagacaaggctgactattactgtcagtcatgggacagcagtcgtactcattccgcggtgacacaggcagaaggggaagtgagacaaaaaccttttctccatctgtcacactctttcttcagctccaggaaaaaactgtggacaaattcatgagcaggtcttgccctgttcacccagatatgagaccttgaggctgcccttccctccaggtctccaggtaggctatgaaaagggtgaatcaggagtcaatacacacacaattattataattttattcttgtttgaagaagaagtagaggaataattgaacatgtaaagtgaaaacatggaaaaccgaaaaagaggaattattgaacttgtaaagatgaaaactacaatgtctgaaatttagaaaatacactgggtgagtttgacaacagaaaaaagattagctgcaaaaaaaaagattagctgcaaaaaaaaagattagcaaattgtataatacagcagtagaaattgtccaagatgaaacacatatgggaaaaataattatggaaattaatgatagaaaggaacagagtatcagtgagttgtaggacaacttcaaacagcctaaagtatgtgtaattagtgtttgaaatagaaatgggtggaggagaaatagaaaaaagtatttgcataaataatggccaaatatttttcacctttggtgaaaaccataaactgaaatatccaagaagctcaacaaaattcaagtataggagacatgaaggaaacaactccaacataaatcataatcaaattaataaaatccagtgatgaagagtcacctaaataataatgctaagagcagttctcattaaaagcaatgcaagaaagaagacggcggagcaatgtcttgaaaacactaaaagaagaatcctgtcaaccttgaattctttttcttttcttttcattttctttctttctttttcttttcttttcttttctttttttctttattttttttttttgagacagggtcttactctgtcacccaggctggagtgcagtggcacaatctcagttcacaacatccagggcttacatgatcctcccacttcagcctcccaagtagctgggaccacaggcgtgcaacactatgcccaggtaattttgtattttttgtagagatgaggttttaccgtgttgcccgggctgatctcaaacttgtgcacttaagcaatctgcccgcatcagcttcccaaagtgctgggactccaggtgtgaaccactgggcctgccaaccttgaatttttttaataaaaacaaacaaacaaaaactttcaaaaaaggagacaaaataaaccctttccagacatatgccaaattaaagaattggttgctatcagactcttacaattagaaatggtcaaggacatccctagacagaaggaaaatgataccacaatgaaatgtgaatttataccgaaaaatgaaaacatcagatatagtaaccacaaggataaacatagaaacctctgaattgtgttaatgtctaataaagataattaacacttcaaagaaaagctaacgtaaatacattgtgatttgtaatgaaaatgaaagtaaattatgtgacaaagcacaaaagctgaagggatgaacaacatgttataatggtcttatactatatgtgaatatataataacacttgaaggtaaaccttgataagttatatacgtactgtaaacccaagcaatcattaagatcaacttttttttttttttttttttttggagtctggctcagtcgcccaggctggagtgcagtggcacgatcttggctcactgcaagctccgcctcttgggttcacgccattctcctgcctcagcctcccaagtagctgggactacaggcacccaccactacgcccggctaacttttttgtatttttagtagagacagggtttcactgtgttagccaggatggtctcgatcttctgacctcgtgatctgcccgcctcggcctcccaaagataaacccttttaacagaaataattatggctagtaagccatattagagttctccacagaaacaaaatcaataggatatgtatgtgtgtatatatgtataatgtatatatgtgtatatgcatgtgtacatataatgtatatgtgtgtatatacatatctaggtacatatatatggagaagaaattggttcatacaattgtggctgactaggatgaaatctactgggcaggctgaaggctggacatttaggtaagagttgatctcgcagttttgagtctgaattctgcaaggtgggacttcaggaatcctcagtatttgctctgaaaaccttcagctcattaatgatgcccacatgcattgtggagagcagtgtgcttatataaagtctacagatataaatgttaatcacatctgaaaattatcttcgtgccaacttctatactcgtatttgacaaaatcaactaggcactatacctagtcaatctaacacttaaaattaaacatcacttaaaccagcaaggagataaaaagaaataatttttaaaaatcagtcaaaaaaaggaaacagaaaaagggaaggagaagcaatgaacatatggcacaaatagaaaatgaagggcaagttggcatatttcaaccaaattatgttactaatcacattaattgtaaatagtctaaatatcacaattaaaaggcagagattgtcatgttgaaatgaacaagactcaactatacatgctgcctagaaaaaaaaccacttcaaattataaaaccacaaaaatccaagtacaaattaaggacaattccccccactcccaagtctgtttcacaaagcagtacaaagaaggattcacagtaaattttttttttttgaagtcttactgtgtcacccaggctagagtacagtggcaccatcttggctcactgcaacctccaccttccaggttcaagtgattctcctgcctcagcctctggagtagctgggattgcctgccaccatgtctgatgaatttttgtagttttagtagagacagggtttcaccgtgttggccaggctggtctcgaccttctgacctcaagtgatccgctggccttagcctctcaaagtgctgggattacaggtgtgagccaccatgcccagcccacagtgaactcttaacacacagttatagaaatatgcatcacctctcccatcaccctttcctctctctggcttccaaaaccttggttctggtaccagagctgagggaaaacattccacagaaatattaaatcaaggtgaagaagggagattctcaagatgtaagtaaaaggcaaatgagggaatggaagtcgcaatgcccttgcatgcataaggacagctcctgcatgagaatgttgtttgaaacattaccgaggaattggtgtccatgttcatgcaggacataggtctataggatatttttgtcatgcctttgtcgggctctggtatcagagtaattcaggcctcaaataggtagtagggaaatgtttgcttctcctctatattctgaaggagattgtgtatgattggtgtcatttcttccataaaaacttgatagaatttaccagtgaagtcatttgtactaggtgggcttttcttagcaggaagattttaaattgctaattcaatatatttatgtgtcatagatctattcagattttctcctttatgaatcgattttgataatttatgtatttccagatacttatccacttcatttaagtcatccataattttggcatttattgttcgcattattccctataaccattgtaccttttgtaaggtcagtggtgatgtcactctttaagtcatggttttgacaatttgggtcaggagaagatttggaggaggagagaacaaggttgtcttgatgttgtcttggctggagtgtgacttggagaaaaatgacttgaatgaaaatacagtcagagggagatatctgtcaagtggttctggtgcctggatttccacatgtgtggtgacggagcccagcccagtgctctactcatgcccagatgtcctggattattcccctgaaatactcaggtgaagctccagctacaccatggcatcctgatattttaaacagagaagaccagtgtcatgggcactggtgatctgctcctcagggcagactcactaaccgtggcagctgggaatcccaggggcctcacagctctcactaaccgtggcagctgggaatcccagggtcctcacagctctcactaaccgtggcagctgggaatcccagggccctcacagctctcactaaccgtggcagctgggaatcccagggccctcacagctcttttctccctcaaattgctgctggctacagagaactgcctccaccaagggcatgcccctttcacagtgtggctcaggcctaataactgcatgagactgaaataccaaggccctgtctcaggttaggatgaccttgcagggcctcccagatgagtcctcaactggagtcagatttcaggctgcccagttgtgcccccccatacttccttccagagcgaatatctccaaacactactgtatgcaattttccctctcagagtctgattccagggaacacaaaatagaaaacagtctacaaggaagagtacggaagaagagagagcagcacagagacaggactctggaatctgcaaatattcctgagcactgatgatcccatgagtggaaggaaaatacttaaggccaagaaaagaaccacccaaagacatttgagggaacaattgcagggcatgtgcatgcgcgtgtgtgcgcacacacacactcacacacacacacacacaccatcagaatagagtttgttcctacaaccagtgtggaaatgtgtctaatcagaggcatcaggttaactaatcagaatttctctgccctggctgagcaaagtggcttacacttgtaatcccagcaatttgggaggctgaggcaggaggatcacttgaggccaggagttcgagaccagcctgggcaacattgtgaaaccccatctctacagaaaacttaaaaaatatagctaagcatggggacatgcacctgtagtcctagctaatcaggaggttttaagcatgaggactgcttcttgagcccaggagttcaaggctgtattgagccatgatctcgccacacagtttcaaaaaaaagaaaagaaaagagaaaaaaaaatgaataagaaaagctctgccttagtatagggggaactaactatagactaaaatctgctcctatccctcctaggacaccgtaagagcaagttcagaaaggaacatactctcttcaagaaacccttctgaatcaaagaagacaaaaatatgtggagaaatataaaaatatcatgcacctaaaaagcaaaacttcacgatgtctggcatcttattacaatagcaggacaacgtgagtcagaagtaaaaaagttggtcagcgcatcatggccctgaaattgcacaggtaatacactttctagaccagaacaaaaagcagttgttgtaactgtaatccatttgtcctggagggtagagtattgatggaacaagttaaatggagacatgaaagacatttaaaaaacacctacatttaagtcctagaaatgaccacagaaatatatgaaatcaaagtactttgaatgagattgctggtatattacatgctgaaaaagaagagattagtgaatctgatgatatagtaatgagaactattcaaaatgaaatatgcaaaactactgaaaatgacaagaaaagagcatcgttgagttatgggacaactgcatgccaatgcaacctaaaataacgtaatttgtgttactgaaaaaaagaagttggtgggggtaggggagtatatagaaaaactacaaaacaaaataatgactaaaaatgatccaaattttgtgaacatcataagccatccattttcacgaagctcaaccagcccctgacaaaatatattttaaaatataaatacgttaagataacaataccaacacatatcataatcaaattgctaaagcacagtgatgaagagacactcttaaaagcagccagaaagaaaagacatgttagatataatactaagagcagagttctcattagaagcaatgcatgcaagaagacaggtagctacatctttataatattaaaaggaacaactgtcaaccctgcagtctttacccggtgaaatatctctcaaaaatgaaggccaaataaaacctttttcaaataaataaaacttacagaattgataaatcacaagccgtcactaaaagaaatgatgaaagacatccctcatacagaacaaaaattataccagatagaagtgtgaatctgcacaaagaatgaaaagcatcagaaatggtgactacatggataaatattttaatagtgcataatgtagaaataaaagggcttgaacagcactatagaacaactagacttaaccgatgcctgtagaactcttcaagcaacaaaagcagaatgcacattcttcttgcatgcacatggaacattctccagaaaaaccgtataaaacagattgataatttttaaaaagatagaaatcacacaaagtatgttcccaaaacaatgtcattagagaaatccaaaaaattgagggaagaccatgaaaactgcatgaaaaaaattgagatgaatggacaaatcactagaaatacaaattctattagaagtgactcaagaagaaatagaaaacccgattaaaactatagaaagagattaagttaataataataagaaaagccttcccataaggaaaggcccagacacagagggcctcactggtgactattaccaaatgtttaaagaagaattaatataatttatcattaaacttttccaaaatataaaagagataaaatcacttgccaactctttctctgaggccaatattaccctgataccaaaaccagacagagccattacaagaaaagataaatacagagcaatgaccttactggatatagatactaaagtccttaacaaaataccagaaaatgtaatctaacaagatataaaaagaagtacatacaataaccaagtggtgtttatccgaggaatgcaatgatggtttaacatctgtaattgaattaattaatagaaggcatcgtattaatagaagaaaggacgaaccatattgtcatctcaaaatcacttaaaatgttttcatgcaagcagactttctttcttgctgtttttaggccatcatgagaagtggagatggcatggggtagtatttcatgcaaagaatctggatattccatactcaactgtgaggatactttctgataaatgtaaaagattgtaatattacgtttctgtatgttcagagaacacttcctagacaagatatgtgtacagaaccgaaaggacaattaggattttggcaggcattgagtgaggagtggagtcactgcaagtgtcagtcagagaacaagaaagatgttaggaaccatgtatttctacctggccatcctactgggataccatccccttcctaacacatcacccatgtggcttgtaaaaatgtccatacttgaaacattttgtccacataattacaggtctagtgctggaatcaagttccctttgatgacatcaggacagttaaaggatctgcgtgtctaactgcccccaggtgatgctaacattgctgccctctgaggaccacaagcaaagtagctcagctcctgacctcctgctcccagcacaggtgagatgcacctcagctacatctgtgaagcccaggagactttctctccctcctcaggctccctggagtgatgacccaggactcatgcctctgcacatttatcctttccctcagagtttggggccttatcagtcctgttacatcttctcagcatctgaaaccactggagaggtggtcaccatctcctgtgctgacacagcagtgacattgggggttataattctgtctcttggtaacaaaagcaacagggaagagccccatatgactgaggggtgagatcaggaaaaagcctcagagattccagttctaatctcaggccgttctttgtattcttttatgagctagttagtcagctggtcagtcagctgtggccacaagaagaaatggaagagaggttcagaaaacagccctagagaccatagacccagagctctagagacagcaggcccaatgtgctacacagggccacagggaaaggcatcaggttcattagaagacagaagacaggagggcaggggatcccttagaccatgacttttatcagaatttcctcaggaaaagcagggcaagctaaaaaatttatgattggccagcctgaataatgtcagcaggctttgggctactaaggtggtctctagctgcttggtacctggccctgggacgataaaggcagaggaatattgtatcctgggatgcacaaaccagacaggggtggtgaggctctgaacacgttagtttccatatgaaaggcaggcttctggctgagcccattgctctttcaaggaatagagaactggggagacccaggaggggtggtcttttcccagacagaaatgttttttaagatgtcaaaatatcaaaatatatagaaaattatatacagttgacccttgaataacattggtttgaactgcatgggtccattgattttcttctgcccctgtcacccctgagacagcaagatcaacccctcttcttgctcttcctcttcagctactcaacccgaatataaaaaagataaaatcctttatgacgattcagttccatttaatgactagtaaatatattttctcttccttatgatttttaaaataacattttctgttctctggcttacttcattataaaaaatactgtatataatatacataacatacacaatctgtgttaattgactgtctaagctaggcctggctctgaccctgatcctgggagacactttaggcagattactctggaaataagtccctcagtctctgaccatctctctctcctcggcgggttctctgtcctcccatgggagctcagtgcccatggtgcagacagcccctctcagctgctcaggaccaagtagggaagctctgctctgtcttggtacccgcagaacccaggctggtgcccatgctgggactttaatgtggtgacaaaactcctcatgcagtgctgattgattctctgacagtgtctaggaatgtaattcccctgaccaggggacaggttgaggatgagtttcaggggggatgacaacaagacttccaatgacacagccacagggagaattgagatgcacaatctgctgtccccagcctggatcacacgctccccctgcatttaggaaagttgcttagaattaggctgaagaggtcaggattcagttttaacattgacctctctctcattttctcttttactctcttttctccttctctcttcctctctctttctttctctttctctatgatactgaagcccttattcacccccattctcagctatgaaatggacatggaaccctgacatcgtgagtttcctcaaggatcacaggagtggagtaaagatctgagccctgtctccaggtgtcctcaagggtctacatcacaggctcctccatcctgctcttcccttacacaggggctcccctcagatcctgcccatgcctaaatttaggccccatttctttgagacctgtggacacttcatcctgaggttcctgagggtttttctccctgctgacgggagatcccactgatcacatggtctgcttgttgtttctcaatcctggagcacagctgcaagtgtcacctgagacacggccaatcccccatacaggacagcagtgaaggtggaagaatcccagagtgaccgggtaccgtcattcattcaaattccatggggctcttgctgcatcactgggtgtcatcctttgggaacctggacttctaaactataagactcagagttagaaaacagaatcataaattccccatgtaagccactacttccacccctggtcctggactcagatatgttactaatgaggaacacagttcctcatagtggctgctgattgaggacatggtgggcaaactgtggttgatggacacatctgtcttgcatcctgcattggaacacagtcttgctcatgtctttatgagtgacatgtggctgttttcatgctgcaatacaaggcttggttgtggtgacagagatcctatggtctgaaaatctgaaatactatactaaaggtcccatactgtatcatgtcttctacatgaattatctacaatagacaaatccatgcaggcagaaagaagatgagtggttgcccagaattggagaaggtgatgaaagaggagaggctgctcactgggtgcagaattttcttttgggtgatgaaaatgtaggagaactacacacacagctggtggctgcccaacaaagtgaaggtgctaagtgccactgcgttgtacattttgaagtgattaattctaggttatatgaattccacacaatacaaaactatgattttcagaaattgactgttataattgtgttattatatctacaactttatgatggcactaaaggaccatgagcagtcaatgcaaaggatccagacaatatttcaagggctcttccagagtaacaagacatgaaaaggcagctctggttctctcttgcctggcgtattttaccctcggagttttttgtttttttgtgttgttgttgttgttgttgttgttattgttgttgttgttgttacagagtctcgctctgtcgcccaggttggagtgcagtggcgcgatctcggctcactgcaagctctgcctcccgggttcacgccattctcctgcctcagcctcctgagtagctgggactacaggcgcccgccaccgcgcccggctaattttttgtatttttagtagagacggggtttcaccgtgttagccaggatggtctcgatctcctgacctcgtgatccgcccgcctcggcctcccaaagtgctgggattacaggcttgagccaccgcgcccagccaaccctcggagtttttatgagcaccgaagggtgcagggagctggaagctacccaccaggtgcctggctcactcatgtctgggtgcagcagctcccccaacaggcagctggcagaactgaaagggaagagctatatccttctgagcccccacaattgtggtgcaggattgttcccgacactcccatccagtctgcttgctcctgcacacttagaaatgatcattatttctgcccaggacctccctggtcttgctctcccctcttcctccccaggcgaccttgggaactttactcaccctctggcccttccctcctctgtccagtgttttccccacccactgtgatcagctcagatcagcgagtctgtgggacattagggatcagtcacccatgtgaggccctcgacggggtcccaggatggagcagtgtatgtccccacaaggctgcttattgcacaagtaatggaggaacaaaggggtgggtaagccccctcctgggcagcttcagaccctgctaaaataggaaacagcctggggcaggtctgaccccacttgtgtctctcctgcccccaccccagcagcagcgtcctggaggccataccatgtgctaagcagatgccaagatcacgtcattcatcatcacctggaaattcccctaaccacaccttaatacgctgcactcgtgcctcagctaaaagtatcacacactgcattgcaatgagtttggatcccagacccccttgatgtttgtcactgctctttcagatcctcgaaaacacctacccctccctgcaggtcagtgacagactcttcttcctcacacttcctttcactgtttcttccttcctgagagcagctccagagactcctcttcagggaggcgccccaacctctgattacacagcagtctgcctgtcattttctgtgtatgcattctattaatgatctgcagagcacctaaacttcatgcctcttttcctaacatgtttattaattgattttctggtgctaaatactcctacaatcaatcaaaaatgcttctcctctgcttggacactcatgagaaacagtcatgaaccatttgctattttatcctcaaaaagtaagtgtggagttcactgctgttccccacatactcaccaaataatgagaaacccagcaattacccaactttctgctccaccatcatgacacagtaggcttttctttcatttgtgtggacttaagacctcaggatggctgctgcagctccagctattatacccatattcaagagcaaaggtgctgcacgaaaacagtctgtttatttccatcacaagagaaaatgttccctgagaagatctccaaccacctgacccttacagccctggggccagcatgggaccatgtggtcagtccaagccaagagtgaccagggaaaacaaggatctttttgtaaataaatagaggagaaaatacacaggtagaagatggtgcttctactacaaactgtttctattacacagccccaacccccatgtaggaaactcctggggtcagagacagtctttctcgtgctgaattcccaggatggaatattgccggatcagagtgggtctcaataaatactggctgggtggatatgctcctgcctttgtttttggggcaggagccaccactgcctcatgtttttctacacctggagccatgaaacttggtgtctgaggtctgcggcactatatgcagagccttggtaagatgcactggaccacttaccaacccagtgacagtagagggatgtcttaggtgggccctacccattttcctccaataggacgtgctcataatttcatgggtaaccgagccccttatgcctggtattgaggcatataaggccaaataaagaagaggaattcctctcttggaaccagcagtccatggacaagggaatcagggacctgagcagcaggttctgaatccacacctgatctggggcaggacccagaacctatcaaagtcttctgctgttaactatagaatgggctcacaaaatgcagacagaatgatctgtgaactccacctggcctggctagctgagaaccaaggccaagacatagtttaaggtaaagatgttggcccagactttgggaccagcaagtgaaggagaattctgtgggctgaggtgggtctgtagggtcctcccctcccctctctgtgtcccttggggctgagcccttctctggaaactacaaagctactccagtagcagcccctgattctgctgacttgcatcacgggccgctttctccatcaaggggataagagaggcctgggagaaacctacccgccctgggccacaggaagcagcatcagggatgtctcagtcatggactggacctttctcagcctcctcgctcactgcacaggtgctgccgccagagtcccagccacccgcccagccccgggctgtgggaccaggctggccttgattgtgagctcagcagggctctgcctgtggtggaaaggatgctcatgaccttgctgcagggtgaggggctggtaaggttgaaatcttcctgtactcctgtgctcatgggcactctgaggggcacagtcaggctccctttcatcccagaagctctgtcccagccaggcaggtgcaaaggaatcctgaggatcagctcctcagcttcaagccttttctccctcatctcctgcaggtttcatggccacatatgagctgtctcagccaccctcagtgtcagtggccccattacagatggccaggatcacctgctgtggaaatactgttggaggtggatatgtttattggtaccagcagaagtcaggccagacccctgtgccggtcatctataaagacagcaagtggccctcaaggacccctgagtgattctctggctccaacttgtggaacacagccactctgaccattagtggggcccaggccagggacgaggctattactgtagcacctatgatggctgagggagcagcaggcagtggctcacagtgaaacagacagatggggatgtgggacaggaacctctaatataactaggctcaatatctcacatcctctctaagccaggatgtccaacattttggcttctctgggccacattggaagaagaaaaattgtcttgggccacacataaatacattaacactaacaatagctgatgagcttaaaaaattgcaaaaaaatctcataaagttttaagaaagtttacaaatttatgtagggccacgttcaaagccatcctaggctgcatgtggcctgcaggctgcaggctggacaagcttgctctaagcagtgaccatgactttggtctcagttcactcaggtggtttctcatggtagccaaagcagcaggagaaactgtcggatttctatttaaccatgaattttacaattacattcattgtaaatccaaacatcttgtccctttattacctgggccctacagagactagtgcacaggttcatgggataagaaatgtctccagagagcttggtttctgcactagagacagtcgtttccctccctttcaacacagagtgtggcaggaaaggaaccagttctctgagctaaccctgagaacttgggcttgagaaaaagaaagcattttgaaccagtaggattgtgcccacagaatgagatgtgctactctggcccagcccaactcctttcatttcaggagctctgtctgggccaggcaggtgcaatggaatcctagggatcagctcctcagtttcaagccttttcttctctgggtgtctgagaacaggagttgtcttgcacgtgcacatgagaaagaagtgcacacacgactctcaggtgtgagcagcaaagacagaacaaacctttccagaaggggcaaatttcattaagatgacagggccttgttacacaaccccacatgtctggactgggatctcctattggatcttgccataaatgcaaggtttcttctcccatcataaattcctgcattgcagtagacccagctgggttctagggctcaaccagcagggcactcccaccactgtgtggacctgctgcagagccttcctgctctaggacccacagacatgcaacttttctttgtttttgctatttgggttggagcaacatcccaagagtgaataatgcttcttccagaatccatcatgaccatatatacttcttgatgcgaagttaggatgtaataatgtgtcctttttttctatgggaggtgctcagctgttccaaacaagaagaccctaaacatttctgctcatatgaaggatgactccctaggtttgctttcctattctctgaatgcatgggtctccccaaatcttccaatgacctttcactgcatgcacatctcatccaaataccaccacatggtggatgcttgggcatggtagcgggtgcctgtaatcccagctacttgggaggctgagacaggagaatcacttgaacccaggaggcaaaggttgcagtaagccaagattgcaccactgcactccagcctgggtgacagagcaagacttggtctcaaaaaaaaaaaaaaaaaaaaaaagaaagaaaagtttatatttttgttctaatggttatcttaatatcttcattctataattatatgttttatataattataatagctatataagatataatacccctagtatgttgttttttggatattctacttgctcctgatggttaatttatgtgtcaacttggctaagctatggtgtcccgttgtttggtcaaatacttgtcaatatcttgctgggaggttatttcatagatgtgattaacactgacagtcaattgactttaagtaaaacagatcacccaccataatatgggtgggccacctccaatcagttgaaggccttaagaacaaaaactgaggtttcccagagaagcaggaattctgcttcaagactgtaacacacaaaccctgcctgagtttctggcctgctgactgctctacagattttaggttccagacttcgagatcaactcttacctgaatttatagcctgctggtttgccctacagattttaaacttgctagtccccacaattatgtaagccaattcctaaataaatctctctatgtataacctattggtttagcttctctgaaaagctttcacatccagtttcctggatgttaagaattactgaaactagctagtaacttactttttttttttttttttttgagacagagttttggtcttgttgcccaggctggaatgcaatggcacaatctcagctcacctcaacctccacttcctgggtccaagcaattctcttccctcagcctcctgagtagctgggattacaggcatatgccaccatgcttggctaatttttgtatttttagtagagacacggcttctccatgttggtcaggctggtcttgaactcccaacctcaggtgatccgccgccttggcctcacaaagtgcctcacatgagccaccacgcctggctcctagtaaattcttcttttccgtgatgtgtctcttacctctaataatacttttcttcttaaagtctacttcattaaaaatagttatgctgggcatggtggctcatggctgtaatctcggcactttgttggaggtcgaggtgggtggatcactgaagcccaggagttcaagaccagcctgggcaacatggcgagaccctgcctctacaaaaaatacaaaaattagctgggtgtggctaatataattctaagttggcacacttgtagtcccagctacttgggatgctgaggtgggagaatcgcttgagcctagaagggagagattgctgtaagccaagatcacatcattgcactccagcctgggagacagtgaggctctatctccaaaaaaaaaaaaaaaaaaaaaaaaagttatacagctttcttggttagtacatgcatgacatatttttcattattttctacctctctgtatccttatataaaaggcattagttgggttttactttattttcaattattttaatttttattgtccttttaaatgtaactaatgatttatttacgttgaaacccaccaccaatttgttttccatgcctattctatttcttcttatctcctctcacatcttgttttggatttattatttttattatttaatttcctccttctctattagtttcataactgtgcagtcttagagttattttaaaagatgacagtggattattttagagcttacaacatgcatccttcacttatcaaagcctaacatgagctagtactttttgttgtggttgagacagagagagtcttcctctgctgcccaggctggagtgcagtggagcaatcttggttcactgcaacctccacttcttgggttcaagcaattctcctgcttcagtcacctgagtagctgggaccacaggtgtgcaccactatgcccggctaatttttgtattcttttttagtagagacagggtttcaccatgttggccaggctggtcttgaactcctgaccttaagagatctgcttacctcggcgtcctaaagtgttgggattacaggcgtgagccaccacgcccagcctatgagttagtacttctatcctcttcctagtcagtagaagaaccttggaacaggaactaaatttacccccagtgacttatatgctaatatttttgtgtattttaaacatatgtgtgtgcatagatgtatctgtgtgttttttgtgtttttattcttatttatgttgagagtgtagagctatgtaagagtaaagagaattgtgtaatgaagccccgagtatccattcaatttcaacaacaatcttatggccaagctcatttcatgtatactctttcctgcttccctctaccccacattatttcagtgcaaatcccagatatataactgtacccatacatatttcagtatgttttatttattttaaaccccacaagatatcattttctatactactgtaatttcataccaataacattcatttagatttacccacacatctacctcttctgttaccctttatttttatttataaaaatatctttgggaaaaaatatccttcagcacatggtcaaggatctcctgagggctatgtcatggacaaaatatacatatatattccatatatatacacacatatacacacacacatatatacacatacacacacacacacacacacacacacacacacacacatatatattccactttcacttttttgtttgttttttgagaccgagtcttgctctgtggcccaggctggagtgcagtggtgggatctcagctcactgcaacttctacctcctgggttcaggtgattctcccgtctcagcctcctgagtagctgggattacaggtgttagccatcacgtctggctaatttttgtttgtttgtttgtttttgagacggagtatcactctgttgcccaggctggagtgcagtggcatgatctcggctcactgcaacctccatctccctggttcaagcaattcccctgcctcagccttccaaggagctgggattacaggtgcatgccaccatgcctggataatttttttgtatttgtagtagagaccgggtttccctatgatggtcagactagtcttgaacttctgacttcaggcaatccgcccacctcggcctctcaaagtgctgggattataggcatgagccaccgtgactggcctgttttttttttttttgagatggagttttgctctgtcaccctggctggagtgcagtggcaagatcttggctcactgcaacctccacctctcgggttcaagcaattcttgtgcctcagcctcctgagtagctgggattacaggcatccaccaccacatctggctaatttgtgtatttttggtagagatggggtttcaccatgttggccaggctggtctcgaacttctgacctcaggtgatccacctgcctcggccttccaaagtgctgggattacagggaggagccaccatgcccagccattttcacttttgaaggatattgttagtgagcatagaattctaggttggcagatattttctttcctcagtttgaaaacatgattccttgtatctgatttctcctgcttttattgggaagccaattctcaatctaattttgctcatttgaaggcaatggctttttatgttgttgtgttttctgagatggagtcttactctgtcgcccaggctggagtgcagtagtgcaatctcagctcactgcaacctctgcctcctgggttcaagtgattcttctgcctcagcctcccaagtagctgggattacaggtgtccaccatcacacctggctaattgttgtatttttaatagagatgaacttttgccatgttggtcaggctgatcccaaactcctcatttcaggtgatccgcccgcctcagcctcccaaatgctgggattacaggcatgagccagcccccaaccctggcctgaaggcagtatcttttttcctctggctgctttgaaaagttttgtctttgttttgagcagtttacactgatgcattgaggtggctcttcattccatgacttgattcttttttgtccattttagaaaattgtcagctttatctcttcaagtattacgtcttccccatcctctctctactctccttatgagactccaatttcacatgacttatgccttgttaaagtatcccccatgtctcttaatccattcctgtatgttctatctatttttctctttgtacttcaatttgtatagtttgtatcaaactatctcccaattagccgggcgtggtggtgggtgcctgtaatcccagctacttgggaggctgaggcaggagaattgcttgaacccgggatgtggaagttgtagtgagccgagatcatgccactgcactctagcctgggcaacagagtgagaccctgtctcaataaataaataaatacatacatacatacatacatacatacatacatacataccagttcactattttttttatgtttgtgtctagtgtgctgttcaaattgagttcctaattccattttttttgagacttttttttttttgagtctctatctgttgcccaggctggagttcagtggtgcaatctcaactcactgtagcctccatctcccaggttcaagggattctcatgcctcagcctctcgagtaactgggattaccaccatgcctaactcatttttgtatttttagtagagatggggttctgccatgttggccaggctggtcttgaactcctggcctcatgtgattggcctacctctgtctcccaaagtgctgggattataggcctaagccaccactcccagcctccatttttttttttttttttttttttgagacggagtctcgctctgtcgcccaggctggagtagagtggtgcgatctcggctcactgcaacctccccctcccagttcaagtgattctcctgcctcagcctcccgagtagctgggactacaggagcatgccaccatgcctggctaatttttgtaattttagtagagatggggtttcaccatattggtcaggctggtcttgaacttctgacctcaggtgatccacccacctcagcctcccatagtgctgggattacaggcatgagtcaccacacctagtgcatccattttttgtagctgccagttttctgatgaaattcttaattatttctttatatccttgatacacatgtaaagaatttattttaaagtacatggtctgatgattttatattctggagatcctatgggcctttttcaaagttgtctgtgctttctcttgagttttgttcctgctgtcttatttccttgtttgcttggttgtttttaatttggcaatggaagttgtgtataaaaattgttacaaataattttttttttttgagatggagtctcgctttgttgcccaagctggagtgcaatgatgtgatctcggctcactgcaacctctgcatcccagggttcaattctcctacctcagcctcccaagtagctgggattgcaggcaggtgccagcacgcctggctaatttttgtatttttagtagagatgggttttcaccatgttggtcaggctggtctcagactcctgacctcgtgatctgcccacctcagcctcccaaagtgctgggattacaggcgtgagccactgcgcccagccagaaataatttttaaaaataatttcgagcccaagcatgatggctcatgcttgtaatcccatcactttgggaggctgaggcaggcagattgcttgagcctaggagttcaagatcagcctgcgcaacatggtgaaaccccatctctacaaaaaataaaaaattagctgggtgtggtggtggtgtgtgcctgtagtcccagctgtttgggacgctgaggtgggaggctcacttgagcctgggtgatcgaggctgcagtgagccatgatcctgagactgtactccagcctgggcaacagagtgagatgctgtctcaaataaataaataaataaaaataaaataatttgaggcctagggctctgaaattctgagatctcctttatgcatttgagtgactgagatgatctgaagctggatccagtgctcctgagggctgctttatttctggttgactgtgactcctagagtaagaaacctgcaccccatgtgtggggtattatggcatcccctccctcagccacatgagtaagtcaacagcactgctctagaccaggtgtggtggctcacgcctatagtcccagctactcgggagactgaggcaggaggattgcttcaggccaggaatttgaaaccagccagagcaatatattattaggttggtacaaaagtaattgcggtttttgcctttaaaagtaatggcaaccctgtttcagcaaagtaaaaagcaaaaaaaaaaaaaaaaaaaggaaggaagaattaaaaaaagaatcagctgggcgtggtggctcacgcctctaatcccagcactttgggaggccaaggcgggcagatcatgagatcaggagatcgagaccatcctggctaacacggtgaaaccccatttctactaaaaatacaaaaaattagccgggcgtggtggcaggcgcctgtagtcccagctactcaggaggtggaggcaggagaatggcatgaacccaggaggtggaggttgcagtgagccgagatcatgccactgcactccagcctgggtgacagagtgagactccgtctcaaaaaaaaaaaaaagaatcactgctctgtctctcagcctcctcttccaggattggccgtcgccttgaggggaatgctggccttgcctgtctccagccctgtacctctctgcctcctatgcctttaagcacatgttttctatttgctgggctgtgaaatctgctcttcatctgatggggtttgctttataggtgactagattcttttctcttggtggttttagatttcgcattttcacattgaccttaaatagtctgattatagtttgccacggcaaagaccctttgcattgcattgtttggggatatttgagcctcctctatctggatgtctaatctcttgttagatgtgagtagttttcattattattttattaatgggctggcatgtgggccttggttccaggcgggctcagaggggcagctgcctgatgtctgggcagcttctctttctgtcttttcttacctggactctgggttgcttgttagctgcttctgccagttctgagttttcaaggggagaggggcccagtgatggctgttctttgaaggaaagggaagaatgtctcctgtttaacatgtttctatgtttccagttacttggttagttagttagagccagggtctctcgctctgttgcgcaggctggagtgcaatggcatgatcgtggctcacagcagcctccaccttccaggctcgagcaatgctcccacctcagcctctcaagcagctgggactgcaggtatgtgccaccatgcttggctgcctttttaaattttttttttttaatacagacaaggtctcactatattgcccaggctggtcttaaactcatgggctcaagtgatcctcctgcctcggcctttcaaagtgctgatatcacaggcagggtttccattttttaaagctcccagcagtggtataaactcctcctttccagagaaagcgcactctgtccgcatccctcatgttgtcctctcctgcctctgcttagggttcactccgggggaaagtgccacttgagagtttcctttttatgtgtggttctgactgaccgctccctgctcacagatgctgcttctcagggtggggtccctgaggcctggagtgtggcctctgacgaccttcagggccaggtgcggaatgagagcctgtggccacatggcccccggtgggagacgtcccgccgccctttgcttctctgtgccactctggctgcacagttcagagccttgggaaacgttaaccagtaggacctagaaggggaggtgagaaggggtcaccccccaggtgtgcctgtggtgagccttcgtgctgagcaggtgcagggagggaggcccaggtgcacacacctgtgaagtaggggcagctggctgggctccttgacctgctccagagcttcttattttctggccacttcacctgcagaaggcccaggtggctgtagccgctagggtcccttgcagtggaaatgatgcctgtcctcagcccctctctaggcctggcgctgtgctcagcaccgtcgtgtgtgtgtatgtatatgtgcacgcatgtgaatgtgtgcagacatcatgaggtgtggtccctgctgttaggcagcttgccttgtggctgaagtgaaccatcacctgaatcaagggatggaaacacaaggccagatgcagtggccttctatggagtcagacggtggctccgtgacctggcttcactccagaactacctggggtttctagctgtgcaaatcccaggtcccactcagattatgagtccagttctctgcaggtggaacccaggaaggtgtatttttaacaagatggtactgctcattcacccagcccagccagtggtcttggcatacccaggaaccgctgacatagagcttgtgctccccataaagtgggaaacagagcgttcctgggtgggggacatgtggcttggtcatgacagtcagggtgttacataccaggacagactgtgttcgggtgacattaaggacaagctcctgcaggctagctgcctggatagtgctggctgggggtagaagttagaggggtcacagaggggcttcctcccggccccctcatcagctgcttgatttagggcttggttctgggtccttctgggcctgattctgaaccatgggactggtgtggcctgcaggctcctcccgccacaagctgttcatggtgcagggggagaacagtgtccacaattccccagacagcagctgtggatgccaggcccccaggagttgttactgaagttgctgctggacagctcgcctttcactgagctccacatagcacccgtggtgatgggagccggatggagagagcctgccagcctgcacatcagctcccaactgggcggggcagagggaggagggggtggggaccccaggcagcagggctctgggagcagtggggccctgggttccaggggtgtctggcaggcccctccttactctacgtctctcagcctctggatggaggtgctggccgcagtcgggctctgcctctgactaagggttggggaagtggcgggtgtgggctgctgccccgtggggcctctgaacagaccccagggcctctgccaatcatgactccttcctttcagctggacccacaggccctgcaggacagagactggcagcgcgccgtcatcgccatgaatggggtacgtgtccgtgggactctcctggcgcccacttcccccagaaggatagggtggcctctgttcatttcaaatcagtcagaggtggctgagcctgaggcagcatctgagagggagcctggttggagaagggagggcccccaagagcagaatcaccatgcacgggaatcgtcattcattggctggaatgcagttgccagccaggccctgagcatccctcctcaaacaaaggtctcatggcaccaccaggacaggtggggcctccactcagggacctgggggctgcccatagaaatggagacccctgatttgtctttaggtaccccagaaaggtttaggccttaaaagcaatgacacacccaaaaaggcccgggtataaatggtaaaatgttaatatttgagattcttggctttttcttacattattctgtctttcctacttaatttttaattgttactaagagaaagctggtcacagtacactataatctcagctactctggaggctgaaccaggagaatcactggagcccaagagtttgattacagcctgggcaacattgcaagatcccatatcttaaaaaaaagtaagcaagcaagagaagcagcggggattttaggaggtgcttctgcagaaaccagtcgtttacatcatcttcaacaatcctggctcttgctgaagtagactaggggcttccccgaggggcggctccacctcatgctgagacctctgcatgccttgggggtggaaatatttgatgagactcccaggggtccttgggaccttgggctatgaggaccagaaggattagaggactgtgccccttctccccactgtagatcgaagtaaagctctcggtcaagttcaacagcaggaagttcagcttgaagaggatgccgtcccgaaaacagacaggggtcttcggagtcaagattgctgtggtcaccaagtgagtggggaggggcttgggctcacgcactgagggtgcctgtcccttcagctgtttctgcagaaaagagcatgtgtgggtctctcctctctgtgcgtggccactgcacggtgaggtcaggccccagggaacacggcgtcttcagctacctcctgtgtttcctgcaaaccagctcaggaatgtccttgccaccttgcttggaagcagtaggctggctccaggaactgcccaagtgcagggttttctgcccttgcttggaattagtcacggtcccagattcctgttgaatggttgtaacccctgcccctttgtcacgagtcagttgccaagagaagcctgtttgttggtttgagagcagttcatgcagacatagaccacttcctctgagaattcatttgcctccctaggatggaatctggctgggcctctgaccttgctggtcacgtgggccggggcctccatcagtcataccctggactcctatctgtgtctaaacaccacgccccacccccactcgcatagcactctgggagggctgtgggcatgagcagcgaggactccatcagcagctcccccagataagccctgctaatgagggggcttgcgaagcagctttgatgtgctggtaaatccaggtgcaaaacagaactcaagttaaggcctccgcacagcactgcgttctaactgtgaaggattcttactctagtgtcctgtgtggaggtattggaattgtccattgctaagactcagaggagaaaagcacttagcatcgcaggacttggagcaccggtgctgaggcaacccttcattcattcgtcggatgtgtgttaaggcccaggcccagggcaggggtcagggattctcctctcacacagcacgtgggtggcaggaccaacaccgggtctgacctcccagacgggggcacaggctgctaaccccaggcctggaatctgtcagatgcccttcccgtgctgacttgacttagacaggcctcctgaccttcccgcaaaggtcatgtgtgattcgcaggggttctggccgcttgaaaggttcctgagaaagtacatgccatgaggacagagcttgcagagggaggacaggcatgcagaaggctctgtgtgcagccccagacctgggtaccttcgtcaccgtcctcaccccacctccgggtgtgcacatagggagcaggtctcctgtgttatggcccaagcagggctgttaggacactgagaacattccctcctcccgcaggagagagaggtccaaggtgccctacatcgtgcgccagtgtgtggaggagatcgagcgccgaggcatggaggaggtgggcatctaccgcatgtctggggtggccacggacatccaggcactgaaggcaggcttcaacgtcagtgagtgtcggcctgcgcaggacgggatggaggtgtgggcagtggtgtccgcgatgagatctcagagtgctccatggcccaggcatgtcacatccttctctgtgtcttttcttcatttactgttttattattttaaaaaaagagaaaacaagagttgtacaaacagcttctatagaagccagtttttacaccatcgtacccactcatgccacttggtggagtggaccaggggcttctgtggggacttggccttcctgccttgggggtggacaggaggtggaagcccaggactcagtgcggtctgtccactgccctgtatgaggatgtggtgggcagagggcactgatgaaattcagcgcaggccggggctgcagcatctccgcctccatctcaccaaccctcacaggctttgaaggacccagactggcctcaaatgccaggggagggcactgagaccccagagggtccctcccagcatcttcaaagcaacaggattttgtgcctgcaggcccttctttgcagcacacaccacccaccctgaccaggacccctagaatgcccagcatccctgggagggccctgtggtagtttcagctccctctgggggcccagaatgaacctggcctgtggtgaggatgtaagcaccaatggccaattgggtccaaaggaagacaccggttcaaacactgaaaccaatcagattctcccacggccttcctgctatcagacgacactggtgcaggggtggttgctatgtacagggcagagccacccaatccccacgcaggcgctgtgtcctgccatgctggcctcctcctggccatcacatcaggccaagcaggggagaggaatgggaatgcccacgcacccctatcaactctgcagacacagaaccatgcacagctcttgggaggagtcagatgagctgctcaaagcccaggagggacccgcacagtggtcagtgtggcagggacggtgctttagccaaggcagggatggcgggtgactcactcaggatcttcaaggaggccgctgcatttccatgctctttccagataacaaggacgtgtcggtgatgatgagcgagatggacgtgaacgccatcgcaggcatgctgaagctgtacttccgtgagctgcccgagccccttttcactgacgagttctaccccaacttcacagagggcatcggtgagcactggaggccttggcctcgtgggagatgtctcccccatgtgcactgctgccctcggaggctgtgaaaagcgaggtgtgggaacctgagttgtaacccctctgccatggtcggcattttaacccaacctcaaaaagcaggggaccagaaccgagcctgtcctggaaggccttgcccatccccagagggctccccatccctattcctcaaggaggccaagtgggtgaaatggtcagcactgccgtgctgtggggtcctaaagtctgctgtcctccttcctgcagaccagggctaaacactggtgcccaggtgctcttgccatgggtcctggtccagccaagcatggtttcaaacatgacctgacccttagtcaacctggaggctgatgtctagagtgggcgctggagcgtgcagcacctgtggcctctgcatcacccttagggcaggtctgcctcccgggcccatgcacagaggacctggtctcccagcctgcaggtgcccctgtggtgtccaggacgacgagggggtctctgcgtacttggtggggctgggaccctcccacttcccacctccttgtgtccctcactccgctgtttcattccatgctgagcctcccctgccttgggctccctggggagggggtggtggcaggagttgcccaagggctgctctgcccatgagcagctgctctagcggctcctcctgctgctgttcgccaggtgctgctgacccctgcgaggtagagaaaaggcgttcaggtggttcacaccccacacaggtgcccctcacagggtcctcactggcggccagcgctgtgggtgtgacgatgatgacaagcctaaactgcgcaaggactcgtgtcccgggcgctccatgtgaccacctcgggagaggtctccggcttgtcgtaacccaggggagtgacccactgcctcctgcagctctttcagacccagttgcaaagaagagctgcatgctcaacctgctgtcgtccctgccggaggccaacctgctcaccttccttttccttctagaccacctggaaaggtagcccagctctcttgtggctgcccaggactccaggtctccaggccgttggggtgcccctctgctcccaccagacccccagcaccaaggaccttttcccccgacccctgtctgcagtaactcactgcttctaaggactagcaccactgccacccctgcccctgcctctcctctttgccacccgcctccctctgcactgtggccttaacaaagagctcagagctttggccgtggccagcagtgcatttggaccgcccccacttccctcccaagcacatcatgaagacctccccatcagcccagagctggccccttgtcccgggccactgagacccagaagtaccaaggctggagtcagcttgcagcacagccagggtcgaggtcactccctccctgaggactctagcatggcacagcccctctgcctctctcctggtggtggcgttgaaacagcaccctctgcttcggtcctctacagggtggcagagaaggaggcagtcaataagatgtccctgcacaaccttggcacggtgtttggccccacgctgctctggccctccgagaaggagagcaagctccctgccaaccccagccagcccatcaccatgactgacagcaggtccttggaggtcatgtcccaggtatgggaagacagcctccagcccatgcaaccccagcctgacagaggtggcctctgcctgccccacccccagtcctgcccatcttcccacttgcattgtatgtggtggtggctgagattcagagagagggacttgcctaggtttgcatggatgggagtgatagggggtgcccaggccacctcctggtcctgctggtgcatcttgctgggggcttaaaaccaccccaagtgttcgggtgtggtggctcatgcctgtaatcccagcactttgggaggccaaggcaggacaaccgaacccaggtgtttgagatcagtctgggcaatgcagcaaaccccatctccagaaaaaatagaaagaaaaattagtcaggcattgtggcacacatctgtaatcctaggtatctgggaggctgacacaggaggattgcttgagcccaggagttagaggctgcagtgatccatgatggagccactgtactccagcctgggggacagagcaaggccctgtgcatctctaaaataaataaccaccccccacccaacaagtcatgccttgtcaggaccccaccccacccccgtctcactgtaaggggttcatgacaccagcaggggtttctagcacctgaggtggacttgggggcttgggccccaaagacctccccaccagcagctgtgagcccccctctgagccactctcctcttccccactctgcgagggcaggtcgaggtgctgctgtacttcttgcggctggaggccatccctgccctggacagcaagagacagagcatcctgttctccaccgatgtctaaaggtcccagtccatctcctggaggcggacagatggcctggaaacctctggctaatcgggccatctgtagagtgggaatcaagattttctgaggcatccttgggccacccccaggtgtcaggccatctgccaagagacagtggcccaaagcagaaggacaggtggcctgggcagatcccgcccaggtctgaaagccccaggctggcctcagactgtgggttttttatgtggccacccgagggcgccccaagccagttcatcttggagtccaggcctggccctgggagacagggtgaaagcagtggtttttatgaacttaacttatagagtctaaaagatttctactgaatcacttgtcaagaagcgccctctctggggagaagggaacgtgaccggattccctcactgttgtatcttgaataaatgctgctgcttcatcctgtgggggccgtggccctgtccctgtgtgggtggggcctcttccatttccctgacttagaaaccacactccacttagaacagggtttgagaggcttagtcagcactgggtagcgttttgactccattcttggcttgcttctttttctttccagaaggatttttgtgcagaaatgggtcttttgttgccgtgttagtcctccttggaaagcagctcagaaggcccgtgaaatgtcgggggacaggacccccagggagggaatcccaggctacgcaccttagggttcgttctccagggagagcgacctcgtcccccgatcctgaccgcccttccggcccacgctctcctgtttggcttccacaggcctggacttctctggcttctctgcccacacactccctgcccccagtgtccctgcccctgccccagcacaggtgacttcatttctgtcctctcagctcagtggactcgctcaacttttgtataagtctccacttggtggtagcagcttgctgatgacttgttttaaaactttcatcctaaataaccttttgatgcttgaatatttttaagttttatacatagtttctaatttttttcccagcagatccagatacctaataagatgctggaatgtaatccctggacaatccgtgtcctggcagcatttggtcttcctctaagcgcctggctccgctgttctcaggagtgggttctgaagtctctggagaacaggatacgtggagggttaggaaggggccaggcctagagacgggagactccctcccggagcaggtggaggcacaggaccattcgctaccccatctgccgacagctgcgggggagcccaggcattctttgtaagccctcctgactacctgactcaaagaaaacagaagcatggaggccgccaagtattttcaagaaataaccccatgaatattccatcacttttttagaaagaggggcttggggcaggcagaggagagaagggagagcaaactgagagccaagtttccagacagtcctgcaggaggagaggatgcagctccccagagggaagcaggatcacatttaaggaagtgtgtggggtccctggatgacaccagcacccagtgcggctctgtctggcaaccgctcccaaggtggcaggagtgggtgtcccctgtgtgtcagtgggcagctcctgctgaacccgcagctcactggggagcctgacagtggggccatgcgcctgacactcctctctgcttgtggacctggcaaggcagggagcagaaaacagagccccttgaaggcttcctgtctgcgtctgtgtgcagtgtggatttagttgtgctttttacttgctgggagagcacagccaccatttacaagcagtgtcaccctcgtgggtggcgaggacagaacaggagcctctgctctctgtacctatctgggcccggtgggctcccttgtcctggcttccatctctgtctcagcgaccattcagccctgcgcaggaacacatgttgcttagaaaagccaaatccagccttgtctctgcctcctctggtctcatgatgtgcatctgttaccttgaaactggaaaccagtctatcaatgtctgtgccaattttttattccctccccaacctccttccccatacgactttttatttatgtaggatgtgtgctgtctaatgatgggatgaccacacttttccatgttctaaaagtgctcctctcccgcagggtcccagggctggtggttgctttgggtctacagctacgtcttacccgcctcctgcctcaacagcctgtgtggtggcaaagccggtgtggggctggggaacgcagcgttctccaggagggggacccggctctccttctgcagtgcaggcaaaggcctagatgccagtgtgacctcccacaaggcgtggcttccagactccccggccggaagtgatccttttttgccgcgggccctgagtttgaagcagcctggctttctcttggtaagtggctggtgtcttagcagctgcaatctgagctcagccacctacacaccaccgtggccgacactttcattaaaaagtttcctgagacgacttgcgtgcatgttgacttcatgatcagcgccgctgggaagaacccctgagccggtggggtggggctggaagcagcaggtgcagtgatggggctgggtgcccaggaggcctcagtgctcaatcaggccaaggtggccaagcccaggctgcagggaaggccggcctggggggtgtgggtgagcacaggcaggcaccagctgggcagtgttaggatgctggagcagcatccgtaaccccactgagtggggtagtctggttggggcagggaccgctgttgctttggcagagagagatgatccccactggggagaggctgttctgactctgcaggtgggacagggacagatggccaccagggtgacccggctggtcttcctttgctatgctaagccctgggacgtggaggattcctgccacacagcctgggcccggtttcttacctgtggccaccgctctggcacgagcccctcagtcttgggtggtttctgcctggtccgggatttggtgttcctgctgagtccagcctttctgccacctccgcatgggccgtgggtggtgttgtcagctgcctcccaccttggcttcagtagctcacccagctcacaggggagctgccctgggctggagatgggcatgcaccctgggtcctacttgaatgaatgcagcttgaggagagccggccatatacactgggccacaggttaccctcggcaatgcccacatcagccgtcagcctgagcctccccaggagagcaaggctcacacgacaaaggctgcccgtggccaatgaggtggctgagcccagccaggacctttctcggactcccgggatgtggctctgctcgtgagctgcctggtcagctctctcggggtgagaggggcttgtcacacgggcccctgcctgcagtgtgacccttctcagcttctctcagcagccctgcctgcggagtgtcaccgccaccatgatcatttccctgacactgcgagggtgtggggacgtcctgggtagagacagggcccgtggcagcagcaggctcaggggcgccctacactggtgggctggggacctggtggagaccacgccaagggctggacaaggggacgagcctccaccctggcctctccgcaggcctcagcagcccctcccacaggcagaagggttgacactgggttctgccctcactgcaagagctgcaagtgccacgtgctgttctgcccaatctggtgtctgcaggtgaggaaagggctgccgctggcccgtttctgagtgttcagcacctaaggatgacagcactgtctgtccctaccctccgggtcctgtttgaaaatcaaacccatgctcacaggccaatttttttttcttttagagacagggtctcactttgtcacccaagctggagtgcagtggtgcgattatagctcaatgcagcctccaattcccggactcaagggaccttcctgcctcagcctgccaagtagcttggactatagctgtgtgttttcttattattttgtagacatggggtctggctatgttgtccaggctattctcaaaattcccggcctcaagcaatcctcccgcctcggcctctcaaaggttgggattacaggtgtgaggcaaggcacccagctcagccacagagccctattgcatctctcttactaggagcaagagctgactgccccctcatccccattccagagtgttggggctgtgttcagccgaggccgggccactggcatggcccagggagcgggatcattcactgctgccccaaatctgagatcattccaccttgacaagacttcctcatccaatccctttacttgacagctggggaaaccaatgcgcacagagcacccccagctcactcggggtctcagagctgatccatgagcggaggctgagatcctgggatcttgtcccccagcctccctgcaaccttaatcccgttctgctgaaagagatggggccggacctcgaccagcagccctggcctggacatgactgtgctcatgcaggtattgaggccgagatgccccggcatcatatgtttttctattttcttttttttttttttgagacggtgtctcactctgtcacccaagctggagtgcagtggcatgatattggctcactgcaacctctgcctcccggttaaagtgattctcctgcctcagccttccaagtagctgggcctacaggcttgtaccaccacacctgactaatttgtgcatttttactagagacggggtttccccatgttggccaggctcgtgtcgaactcctgacctcaagtgatccacctgccttggcctcccaaagtgccaggattacaggcatgagccatggcgtcacttaaatgtagtgagaggccgggcacagtggctcatgcctgtaatcccagtactttgagaggacgaggctgtcagatcacctaaggtcaggagttcgagaccagcctggccaacatggtgaaaccgtgtctctaaaaaaaaatagaaaaaaatagccctgcatggtggtgagtacctgtagtcccagttactcaggaggctgaggcatgagaatcgcttaaacctcggaggcggaggctgcagtgagctgagatggcgccactgcactccagcctgggtgacagagcaagactttgtctctaaataattaaataaataaatatggctgagcatggtgccttaggcctgtaatcccaacactttgggaggctgaggcaggtggttcatgaggtcaggagcccgagaccagcctggccaagatggtgaaacactgtctctactaaaaatacaaaaattagccagctgtggtggcaggcacctgtaatcccagctacttgggacactgaggcaggagaatcacttgaaactggaagtcagaggttgcagggagccgagattgcaccactgcactctagcctgggcgatggagaaagactccatctcaaataaataaattaataaatacagagcaagattccatcttaaataaataaataaataaacatacacctgtaatcctagcagttcgggaggctaagacaggtcgatcacctgaggtcaggagttcgagaccagcctgaccaatatggcaaaactccatctctactaaaaatacaaaaattagccaggcgttttgatgtgtgcctgtagtcccagctacttgggaggctgagacaggagaattgcttgaacccaagaggtggaggttgcagtgagccgagatctcggctgcacttcagcctgggtgacagagtgagactgtctcaaaaggaataaaaaaaatacaaaataaaaaaaatgtagtaagatggcagagtcgtgccgcggaagcgtgctggtcctatccatgtagtgaaggctgatttcatacagaaatgtcacaagaactttttttctttttctttttttttgagacggagtctcgctctgtcacccaggctggagtgcagtggcgcgatctcagctcactgcaagctctgcctcccgggtttatgccgttctcctgcctcagcctcccaagtagctgggactacaggcctgtgcagcagatgcaggggggccactaggcccaggcagtcttgggacttgtgtgtctcctgctgtgcatccatactgggtgctttagaaacggcaggcagaccagaagcccctgttgcaagtgaggacaaagtgtgggaaggccgtgagggtctgcagtccgagatggcctggtcctcaacctgcagtgcactgttgatgcactggaatgccgcctccttctcccagtccaggtcttcagcagtgacccggtaccccagctctaagggaggtggcagcatcaaaggctcccctcgcctgcgtggcagcaggggaaacttgcatctacggggcctagaggcctgggatatgggggagccacccctgggagcgagtgtctgccctggtgctgtatctgccgtcttttcacactgggtgtgacccgaagagacagcctgaggtccgtcctcactcactgtgtttgaggaactgagggtcagctggcagtgggatgaggctggcccctcttccactttcgttccgggaggcctcccgtagagctgtaggggctcgagatggcatttcatttggggcacgagctggtccgggaggtctgcgatctctggttctgacctctgggcacctgctgcagctgtggctgaggcccagaaatgtgaagggcctccatccactccagtagtgaccccaacgtggggttcaatgcggaggggggaggggctgctgcggcagctgcaggagcagaagtgccacgccttgttcttctcatgcccgcatccatgcttgcagctgggaagggggcaggaatcagcgaggtgacctgggctgagtcctgggaatgggaagaggtggcaggaaggggatctgaggaggagaacagggggcctggtggtctgtgcttcttcccagacatgggagctgtagaggggacctctgcagcagatgctaagggggccagtaggcccaggcagtcttgggacttgtgtgtctcctgctgtgcatccatactgggtgctttagaaacggcaggcagaccagaagcccctgttgcaagtgaggacaaagtgtgggaaggccgtgagggtctgcagtccgagatggccttgtcctcaacttgcagtgcactgttgatgcgctggaatgccgcctccttctcccggtcaaggtcttcaacagtgacccggtaccccagctctaagggaggtggcagcatcaaaggctcccctcgcctgcatggcagcaggggaaacttgtgtgtactgggcctagaggcctcggatgtggaggagtcattcctgagggtgagtgtctgccctggtgctatatctgctgccttttcacactgggtgtgacctgaagagacagcctgaggcctgtcctcactcactgtctttgaggaactgagggtcagctggcagtgggatgaggctggccccctcctccgctttagccccggcaagcctcccgtggagctgtaggagctggagatggcatttcggttggtgcaggagctcgtccaggaggtctgggatgtctggttatatctgatttctgacctctgggcatggaggtctgtctgcagaggcccgggcccgggcacaaagggagagaggcctccattgtcccgcaggggccgaaatgcagacggtgcatccccggtgacctccgggacccttctctgatcaccaggattctcttggactctagggtccttgtcctgctcaggcatccctgccccgctctccttgagggccctcaacactatcttccctggacacaagtctggggacagccgggtgttgtggaccccaaaggggtgactcccggctcctgggccccacagagagtccatgttctcagtgcagtggctgagctggaggacgccctggaactcggagcacacagcactggcttgctgtggtacctgtgcaatcaaattgaaggcaggatcccaggaaggaacgcagcgcttgcaggatcaccgaaaaccttcttagagttgtcttgacaccactgatgtcaagtgtctgggtacttgtaggatggcctgccactcagtgcacgggcaggagcaacggggagatcccacaggcaaagtgaactgggggatgggctgaacgggctccaggcaactgagccctactggcaggtcctcggcctgggcccgaacaggaaggaggggcacagagtgcccaggtaaccgctcctgggagcagtggggaaccgtcggttgcttgaactctcgagagctgggctctgagcgtcctcgtccagccgccaactcggccaacggctaagccagcagtttcttctgttgccgggcaacgcgccttttaaacctgagggagcgggcgcgtgagcacatcacggcgcccgtgacagagccagcttaacggattaataagcgcagccaggtacccgcgcgaggcacttgctggcaatggcgggaggcggacgtggggggtcatgcaataggtactggaaggagagaggcgggcacaaaggtcgcgggaggaacaggtgcccacaatggcggcagatctgcccgtggatcactgaagattcctgctctcctgctgaggtggagattgcagtgagctgagatcgcaccattgcactccagcctgggcaacagagtcagactctctctttttttttttttttttttttttttgagatggagtctccctctgtcgcccaggctggattccagtggcctgatctctgggctcaccgcaagctccgcctaccgggttcacgccattctcctgcctcagcctctggagtagttgggactacaggcgcccgccaccacacccggctaattttttgtatttttagtagagacggggtttcaccgtgttagccaggatgatctccatctcctgacgtcatgatccgccctcccaaagtgctggcattacaggcctcggcctcccaaagtgctgggattacaggcgtgagccaccgcgcccggtgttgaaactcccttgaggcattttcttcggccttcgggtccatcctctgtctcctccttgacctcctcatctcctcctcgccactgccttggggaccttggccaggctcatggcatccagcagccactcaatgtcaatacctccatgttcatctctcagcccgcccttgcccgtgaacccatgcttatttatttattttttttatacgtgcacccatgctcttcaggtctgatgaagtatccaaaatcaagctcctgaccatcctcaaacctgccccttctgcagggtttacctcgctagtcggcgccatccttgattcttctctttctcccacccaggccatcatctcttgcctggttgatacccacagcctcccctttgggctttatccttatccccgtcatagctgccagagggaccctgtgaaaacactccccagcctgctcattcttctgccctaagcctgcatggcacagagcaaaagccagttgttatgggacctaggaggtcctgtgggatgggccccagcctgcatcttcatcctcttctccccaccccactccattcactctctgcctatcgctcaccagcctataccacctgcctcagggcctttgcactgaccatttaggcaacattccaggctcttttcacacgttgcctcctctgagaagccctccctgaccactctgcccatacctcatgcctcttgattccccttacctggcttgtggtttcagcactttccctgtgtgtgtttgtttttcttggcatgagggcaggacctaagtgtctgttccctgttgattccccagttccaggcatgcagtgcaaattctagaaatattttttgcatgaaggaatgagtgattgaatgcagcaagggtctggaggctgaggaccaggcagacagacattcagagttgctggaatgcgacagagacagggagtcagactggtcatgcaagatcctgggcctgcccttgggtcctggggagccacggaaggttgtgggtgccagagggttgtggtcagagccacagtcaggggccttctgagacctgtgtcccctccccaccctccctccccacctcctcaggccagctctggggtctcggcaggtggtccacaacatgacctctgagttcttcgctgcccagctccgggcccagatctctgacgacaccactcacccgatctcctactacaagcccgagttctacacgccggttgatgggggcactgctcacctgtctgtcgtcgcagaggacggcagtgctgtgtccgccaccagcaccatcaacctctagtaggggctgctgggccgcctgggtgggaaagggccaggggcgggtggcccagggactgcccacttatccagtaaggtggctccatcacctcttttcctggtgggaaactgaggcccaaccttggtagcttatcctgggcctctcagtgagtatgtttgagcctcagtgggtggatagggaccaggctgggccaggcaaggtcaggtgctgtctgacctggctgggcggtagctttggctccaaggtccgctccccggtcagcgagatcctgttcaatgatgaaatggatgacttcagctctcccaacatcaccaacgagtttggggtgcccccctcacctgccaatttcatccagccaggtatggggtggaggtctggggatgggggactggggtggagaggggcgggtgtcctgggcaggcagctgacgggcatccctgtcttctcccatcggccacagggaagcagccgctctcgtcaatgtgcccgacgatcatggtgggccaggacggccaggtccggatggtggtgggagctgctgggggcacacagatcaccacagccactgcactgatatgtgtcaccccttttctccctggccgtgcccaccctgcacagcccccaagccatgctgatcacactcccatgccccaggccatcatctacaacctctggttcggctatgacgtgaagcgggccgtggaggagccccggctgcacaaccagcttctgcccaacgtcacgacagtggagagaaacattgaccaggtgggccgggggttggagaaactgagtcacggtgtggggccccagggcatcctgggctggaggcctggatcatcacagagtggacaattgttggtgtcctctctctagtgcctgggccatctggagcccctgtgccatgagggccaagccccctgctccagtgagacccagcaggccccaacctgctcttcctgatgacctggcccgaaatggcaccacctgggctgaggcctgtgaccacacaggtgtggttcaggtggcatctggagccctgctcaggcttcccctctcctcccacccccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggactggcttcccctgtgagcagcagagcagcacaataaatgaggccactgtgccaggctccaggtggcctccctgccctgtctccccactctctgggcctcagtgtattgtgtgtgaaatggagccatctgactggggaggaacagagaggtgggattcggagatcttcacaatgcggacactggaactagcctcagcatcttcagcatggggagagccaggcacatggctgggggccaggggaaggttcacaccaagccctgcccctttccaccctgatccctcggactttggggccaggccctcccttactggggctgggcagtgacactacctaggatcagccaccagggggtgccacgaccctggcactttcttaggcagagggtggccagctgatgctgggaacccgggcgccttctcagacccgtaggcgtccagctcaccctgccgatgacactggaggtgaagctgaggtccgaggaatggggactgggcaacaggctggaggaaaacatctcggtcagagccacgcccctggggggtttccaagagcaagcccagagtgaaacccaagcttgtgatcctctccagagggaggcctggttctcagggaacagcaaacgggaagatgtccccagatcccagggatcagggcttggaccagccggggacgcagcccagagggagtgggtccagaaggaaacagctagacacagcagccttcaccatccgcagcccctccaggcctccctcggggcctgctccctcctctgtgcacagttccaacacctggggcagggttctgggaagggctggtggaggtgggctggtgggaggcggtgatcacagcccagcacctggatatcaccaggggcactggggccaggggccaggtgaggccaggtcggggctatccttcaggagccccgaaaacctggtgattccaaagggcccatagacaaacaggtttttatgcctgtggagtcaagtcccactgggtctgagctctgcagggctgtgtctctggggctctgcaggggtgagatggaggtgggctcaaatggtgtacaagtcactcctcaatccttattttatttatttaatttttttaaaaaaaatttaaaccaatagagatggggactcactatgttgaccaggctggtcttaactcctgacttcaagcagtccccccatctcagtctcccaaaatgctaaaattacaggggtgagccagtgcacccagcctcaatccttattttggcctgagaggaaaggccgtggccccatttgcaggggagaagactgaagctggaggggcaggccttgctctgggttgcacagcagcaagagaagtgggagctggccacgaggcttcctcgactcgacacactggtggggtacaccctggttctccaggtcccatggggctcagcccaggactacctcggggggtgaggtacttaaatcctctccttcattctcatcgccctttcccccatcatttcctgaggaagaacattcagggacctgaaggggtggcctgcccctccacatctgtgggtgtttctcatcaggtgggacaagagactgagaaaagaaagagacacagagacaaagtatagagaaagaaaagtgggcccaggggacctgcgctcagcatacggaggccccacgctggcaccagtctctgagttccctagtatttattgatcattatctctaccatctcagagagggggatgtggcaggacaatatggtaatagtggggagagggtcagcaggaaaacatgtgaacaaatgtctctgtgtcataaacaaggttaagaaaaaggtgctgtgctttgatgtgcatatacataaacatctcaatgcattaaagagcagtattgccaccagcatgtcccacctccagccctaaggcagttttctcctatctcagtagatggaatatacaattgggttttacaccgagacattcctttgcccagggacgatcaggagagagatgccttcctcttatctcaactgcaaagaggccttccttcctcttatactaatcctcctcagcacagaccctttacgggtgtcgggctgggggacggtcaggtctttcccttcccacgaggccatatttcagactgtcacatggagagaaaccttggacaatacctggctttcctaggcagaggtccctgcggccttctgcagtgttttgtgtccctgcttacttgagattagggagtggtgatgactcttaacaagcatgctgccttcaagcatttgtttaacaaagcacatcctgcacagccctgaatccattaaaccttgagtcgacacagtacatgtttctgtgagcacagggttggggctagggttacagattaacggcatctcaaggcaaaagaatttttcttactacacaacaaaatggagcctcttacgtctacttctttctacatagacacagtaacagtctgatatctctttcttttccccacagggaccttcctggctgtgcctcgggtcaggaccagaatgacacccattcatttccctgggcctttgctccggtggtccctgcaccctggcctctgcctgacgaggatggtggggagaggaggggggacgtcccccacactgctgtctccactgttcctgctgcccaggcctctgggcttccaggactacagcgggtgggtgggtgggctggcctgagcccaggaatgcacttcagttcctggttgagcaatgtcactgaggcttgggagtcgggtgggggcgggaggaggcgtccacaggccccccctaccgtgagaggcagccgtgggaacagcctacctctaaacaatcactgcagcccaggctgaccaggggctctggccggacataggggcctggcaggctgtgtgccctgtaaggacacagtctgtctctgtgcctcagtttctctgctgcccagatggaggggcccagactccaggtgtacacatctggagcaggcagtgttcagttggggaggaagcggggaggactgtgggggccatgtgggaaggattccaccccacatcacctgcacccctgctgagcctggtcaacggagcccctcagtgggtcctcactctcctggctgcctcccatttaggcaccctgaggcctggggagaacagagccaggccagtgtccctagagaggctgcgctgccagcacagtagtagcggatttggattcagggaagcagacctgcagccagggtgggaaagagctgcaggcggggtggagcccccacatggcacagcccccctccctggaggtccatgctgcatttccaggacagcaagtcccagggatggatggtgcctggtgccaagggctagaggcatggtctgtctgcattccctacaggggcatcttgtagtcaccagcatttgatgctgtcaagtccccctgtcctctgtgcagactgggaagcccttggtcaccctggggggtggggggacccaggccaggctgcagaagcataaggacttgaacccgggtcctgagtgacaccaccttgggtcctcctccctctgcctctgttcagctccaccttgatgctgactaggctgggccatgcggagagggttaggggatagagatgagagctggggagcagggctccactctgggaggggggcagccttgcgggatccagggcagagttaagcggccccagctccgctttcctagagctgctgagaacccgggaaatggtgtggaggttccggggagccctgcccctacctggcaaccgcagtgcaacaggcaccaagttctcctgcacattgcgacagtgggaccctgggctctggcgggcggtaggtggggcctttggacctaccagcagtgagggagttaacacagcagctgacttctctaggcaaggaaaactcccctcagacgctttgctgcctggcctcctgccagcaacaagcaggagctgaaaactagaagctgaggcatgagtttggtcactccgtagtgtgcacttggtgagggcagcagctggccacagctgccagccgtctgtccattcgcccatctgtccatctggcagcccgctgttcagacctgtctgtctgtccgcccatctgtaagcccatctctgtcccattgtctatctgaccatctttctcttactgtcctctttgtctagctatctggcctgtctgtcgatccatcttcgtgtctgtcttcagcccccacctgtttgtccatctgtccaattacctgtgagtctatctatgcatcttcttgtccattcatctgcccacccatctgtccctccgtctgcccaccggcctcccctctccttctgggccgcagagccacggcccaggactgcagagccatggttggcctggtcctgctggggctggggctggcgctggctgtcattgtgctggctgtggtcctctctcgacaccaggccccatttgacccccggcctttgcccacgccgctgttgctgctgactccaaggtctgctcggatattggacagtgagtgagatgtgggaggaagctgggtggcccttggcagccagcccctcctggagaaggcgtgtgtgtgtaagcgtgtgtgtgtgtgagagattatgtgtgtgtgtgtgggtatgtgagtgtgagtgtggggtgtgggtgtgtgtaaatgtgtgtgatcgtgtttgggtgtgtgtatgtgtgagtgtgtgggtgtgtgggggtatgtgagtgtgagtgtgtggggggtgtgggggggtgtgaatgtgtgtgattgtgttttgctgtgtgagagtgtgtgtgactatgagtgtgtgagtgtgtgttggtgtgtgggtgtgtgtaaatgtgtgtgattgtgtgtgtgagtgtatgtgtgggtgtttgtgggtgtgtgtgagtgtgtgagtgtgagtatgggggtgtgggtgtgtgtgaatgtgtgtgattgtgtgtgggtatgtgtatgtgtgggtgtgtgtgtgcatgtgtgtgtgtgtgcgcgcacgtgcactggcccaggaagcaggagccgtgtgtgtgggcttcagcacctgcaggacttgagcgcaaggagacagcctcagggcccttgcacagaacaggtggcagggtgtgcccgtggggcagatggggacttggggacaatggtggtgtgtgagtccatacctggctccaggattcaggaggcccatttgcatatcccaggtgggaacctgtctggccccggctgaccctgctggccggtgcaggccccttcagtgaggccaattctccaaggctgcggtcttctcccagggtcatgggtgaaggggtttggaggctccctgcgtgggtactggcctgctggggtacacacaatgctgccatagccagtctgcccctacacccagcccggggccacatctcaggtctctcagtcctgaggagcccggtgccccacccctcacatcctctctccctgagtcagggcctgggtctcgtgagctgagtgactgatacttggtgtcctggatgagggcgtggtggagaggggccacagcgggtgtttcctgaccctcttccaggaaggtgctgctgccgctgcagggaggacacatacaggatgccccttcctgccccctgcctcccattgggcccacaaaagccagggcaagcctcccctccctgccagccacctggtctgcttcccagaaattctgtcttgcaggctgttgggaggatcccagtactttgtaaactaaagcaagggaggagtggccgttctctctctttgctcattcattcaccttttcattcattccttcttccctccattcccccatctgtccatccttccctgccctgattgctcatgccaccccccctccagcccctcctgacctggtcctttggtttctcttcagggctttctgtctcctcccacagggctgagaatggcagctcagggacaagtgggggctggggactgcttagtctccccagtggctctcaggggatttgagggtttgacgccagctgccaccccaggctgtgcccctcctctgctcaggaggacatgcagagatgcgacacccacttaaactcgaagttgcaaagatgcaaatgagactggggtctcaggcaccagagaccacccatgggcacgtggcttttgggagtggggacctgctgccacagatctctgaagagtctggacctgctgggtctccccgagtgactgtctgggggtctccatagcatgccctgctgtgtgcgcgacggtcactggttgggtaggggtctctactctaaagctccctctgccggcatcccctcgaactctcccttggtgaagagaggatgtggttttcccccagtgttttatcaaacaactctctccacttcctgttttaagaagctgggagtggaagagagcctggggctggccccagctgctgctgcgaaacaggggtcactggacgctgggaccctggccgggctggctggaggcctcaggaagaggcctgctacagtgtcatcctggccaagattcctccctgcagaggaccctggccacactgccacagggtctgctggggccaccagaagcccatgctcctgcctccatctctcccctttgtgctcacctctcaccaggaggccctcccagagttcagtctcctgcttttctttttttttttttttgagatggtgtctcgctctgtcaccaggctggagtgcagtggtgcgacctcagctcactgcaacctctgcttcgttggttcaaatgattctcctgcctcagcctcctgagtagctgggactacaggtgccagccaccacgcccagctaatttttgtatttttagtagagacggggtttcaccatgttggccaggatggtctctatctcttgattcgcccgccttggcctcccaaagtgctggcattacaggagtgagtcatggcacccggcctcatctcctactctttcagcaccaggttttattcttgggattctgctacagccgcagcccctgggtgcgagctcctaagctttctgcgagtgtggacccagcaccgtgcctagtagacatacaaaaggaacatggtgacagtgaggtctgtcatctccagcataatgactcttttgatccttgtaaaaaaggtgatttttggctgggtgtggtggctcacacctgtaatcccagcactttgggaggctgaggggggtggctcacttgaagtcaggagttggagaccagcctgggcaacatggtgaaaccacgttctcctgggtgtccaggtggtccaagaccccatgactatatcatgacaggaaagagagagttaataaatctgagggcataaaatgtgaacatatactgtttccatcccacatgaaggcacatgtgtctgagcctactctctgggaggaatagagatctcagtttccacatcagggttgcattctatgcacctgcagccatgttattctgctgtagcagatgctacacttggcaccgacattgcagatgggaccatgaccttactggagttgtagaaatctactttcaccttccagaatccatttaatgtttataggagctagtccaagaaattagatggaaataaagtcctgctacaacctgagaatctttaggcctttaaaggtaacactattacatgcaactcccaatgaagggtgaagcatgattattatttaccttttttgatggggtgaaatggggagagagtcggaattcatcacatacataaaaggcaggtcgtataaatgttagtgtttgtgagtcacaaggtctgtcttgcagcgactcagatctgcacttgtggcatgaaagcagccattgactgaacataaatgaagggatatgggtttgtttaatgaaactttatgtacaaacgtaggtagtcactatggtttgctgaccccagcttttccattgccccatggaactttctttgggatgcctttttgcagtgggttctaggtgagaaaaattggctcggatctggatgctgaagttgagactggtgctgtcatgtggctactgccctcgtccatcctgggtgacttctgactgttgtgatgagcagggccctttgtggctgcctagctcctggtgccaagaatgatgaaccctctgcattgccctctgcaaagcagaccacaggacagccaccctgaattgctcgttctcactgtgtccaccttgcctaagatggttgggcacattcactggctggttaattccagatagtgttatctcattaatgccaggcagtaccttctagaagaggctcctaccatctgcactagactatggagcttctccggggtgctagtgctctgtcacctgaatatgcttcagggatttgctaaacagaatgtccttcaggccctcccatagaacacagggaaacattttgttttcccttgtgtgactgcaaaagggaaaacaaaaataagcctgggaaagggtgatttaggactttgatgatgtcgaggctgggaactcccatcagagtttctatatatgatggggaggggccaattttttgaaagtcagcattgactggccattggacacaggtggccctacattgactctctcttgcccaggacctctcctcaaaaagtctcaggtgattcagccccacagcagcaggggcacgacaccttctgtcctgaaggctgataaccggtgatgtggacagctgccattcactctggggaagatgctgcctaattccacacccaccgcctgcatgtctagtgagagcctgcctattcctatggggacaccccaaaattagctccaccaagaagcctcctccacctccattctccacagaagacactcatcttatatgcttggctacaggtcctgtttgctctgctattatccctatcacctgtccctgtctgttcaattgtctcacatgagcagagagacgatgtctcattcagccttatttcccatgggtattaataaatattcattgagtcaattaaaaattcatgtaataacctatcaatgcatgtctctgtgtgaggtaaagaaagcatcctgattgtaaatataactctcatgttaaaagctgggagcagtggctcatacctgtaataccagcactttgggaggctgaggagggtgaattacctgaagtcaggagtttgagaccagcctgatcaatatggtgaaaccccatctctactaaaaatacaaaaattagcagggcatggtggcgtgtgcttgtaatcccagctactcgggaggctgaaacaggagaatcacttgaacctgggaggcgaaggttgcagtgaaccgagatcatgccactgcactcctgcctgggtaacagagcaagactccgtctcaaaacaaacaaacaaaagcattcttacagattatcttggcttttattcctttattctaccaataagttgttagcctctcttatgtgccatttgttacaaaaaatcagctgtcatttttatggagactgagaagtcccctgatctgtccattgtaagctgaagacccagtagggccggttttatggattagtccaagccccaaggcttgagaaccaggggagccactggtctaagactcagtccaagggaaggagaggatcaaggtcccactcatgcagtcacacacaaaggaggaattctccctgctggtgccttttgttgtatccacgccttcagtagatttgatgatgccaaccacacagaggagggcaaagtactaacttagtccaggcattcaaacatgaatctcatctggaaacaccctcatagacacactcagaaatagtgttcaatctgggcacctcatggcctagtccatttgacccataaaacttaccattactatcattaaaatggcatacgttatgtatattttgttaccataaaaaatttacattctgaaaataaagtacagtgtcttagctcatttgtgctgctacaacagaatacttgaggttgagtgatttacaaagaacagacagttatttctcacagttgtggaggctgggcagtccaagatcctggtgagggcttttatactgcattctcatgtggcaaaggcagaagggctggagaaagctaaaggctgcatgaagcctctttcctaagggccttaatcctctcaagagtgaggagctgtcatgccctaattgcctcttaaaggccatctcttttaacactaccacactggcaacatctgaattttggagaggacacattcaaactatagtagcaagtttaatttggaaataattctactcaaaaaagcattagaattgagtaatgaaaccctgtatatcccctccctggatgcaacaatggggtacgttgagtccaatccagggagcattctcgcttcctctctctactccatcttaaaaaattaacaataattttctgtccactccataatcccatttcaccaattgcccaaaatacctacagtagttatttaattatgtttactaacagaatcctcaagattccaacccttatatttgatttttacttctctctgatcgatctggcatttatcgacgaagattccatcaaaccctgggcttatgaaaaattttgcaaaaattccacagataggaaagtgttcattgtgtgcagcagaaaaatgttcatcatgcagagtggaaacatgtttatgtgtggcaagcaatggtaaagtgagtcctgcattttaaaatgaaaggacagtagatggaaattagaggtcacactgtgaaataatgaattctgttaaaggcaacaacataggttagtataaaaggcagcattatggtatttttggttagtaacttctctttggaaacctatcacaagcagagagactgaatccataattaaaaccttccagccaaagaaagtccaggaccagatggcctccatgttttttatatcagccatttaaagaattagcatcaattcttatcaaactctgaaaaactagaagaggaagaaactattcctaacgagcccaacatgaccctgaccgaagtcagttaaagaccctacaagatgtgacaactaaagaccaatatacctcgtgaatataggtgcaaacatcctcaaaatgtgtgccagcaacatgaatccaacagcatattcaaaagattatgtcatataactaagtgagattaatatcaggaatgtaaggagggttcaatataagaaaatgaatcaatggaatatacaacattaatagctcaagagagaaaatacatattccaaataacatagaacaacaaaatccaacaccttctctaaatgaaaaaaaaaaagcacccagaaaactagaagtagaaggaaacaacctctgtgtgataaaaggcgtttgtaaaaatcccacaacaaacttcatactcaataatggaagaccgaaagctatccctctgacatctccggatgcctaaccttatttaagtgagttcagcaaagttgcaagatgcaagatcaccatgcaaaactcattcatatttttttttggggggggatggaatcttgctctgttgcccaggctggagtgcagtggctcaatttcggctcacctcaagctccgcctcccgggttcacaccattctcctgcctcagcctcccgaatagctggaactacaggcgcctgccaccaagcccagctaattttttgtattttttagtagagacggggtttcaccgtgttagccaggatggtctcaatctcctgacgtcatgatccacctgcctcggcctcccaaagtgctgggattacaggcagagccaccatgcccagcaactcattcatattttatatgcaccagcaatgaacatctgaaaaagaagttttaaaagtaactctatttacaagaccaccaaaaagaatacaaataaatttatccaagaagatgaacttcttgtacactgaaaatgtcaagacatttctgaatgaaatgtgcagagatgcctcaggtggctcctgcatattccgcccctggtgaagcatgtttgcattttcttgggaactgagcacctcctgcttggtcgtaaggcagacaggccacacagagaagaataattcctccctttgggccagcagttcagggatcaagaaatcctagacctgaggagtaatttctgaatctacacctagaccaaggtggtgtctgagcctccagcagtcagtgaagagcaaccagcagtggtcaacagagagtcacatggcaaagccgcctggagctgggctggacctgcatgtcagggagatgctgacatgcagggagggtcagtgaccatgacctaacactggggggaaaaatgtccttctttttctagagtatcatcgttaacattgatgtacaaactcttttgccccatgtctcttacatctggctcttttagaatttgcttatttcacagcaacaagttcaagtcttatactacattgcatcccagcccacccaattatgctaaaactctggatctgtcaaacactttcagagcagcagatttgtacctggccctaaacgcatagtggggacactgaggcacagctcctagggccttcccctgaagctccaccaagggcaaaaacttatacaagcttcatggatattaaaaacctccatgttcacttagcaagggagaaattttattcaagttctgcagctcaggagctgtgctcaagagcaagacccagaacttctcaaagcctggttttggcacctgtagaatggagcccaaaaacgcagacagacttacctcggagctctatagggccaggacagcccaggagtaaagccagtttgagacacaatttggggtgaagatgtcggcccagaatagaaccaggagaggaagaagaaacccgtgtgctgagagtgggtctgctgggaccactcctctccttcctgggccctttggggctgagcccttctctaaaaaccacagagctactccagcagcagcccctgactctgctgatttgcatcatggccgctttatccagcaaggggataagagaggcctgggaggaacctgctcagcctgggtcttgggaagcagcatcgggggtgcctcagccatggcctggacccctttcctcctcggcctcctccctcactgcacaggtgctgcccccagggtctcactcacttgcccagccccaggcctctgggtccagcctggccctaacactgagctcagtagggccctacctgtggtgggcaggatgctcatgaacctgccgcagggcagggggctggtggggcagaaatccccccacactgtgctcctgttctcttggtgccctaagggcacttttattcctggggctcaggtcagttcaggcaagtggcaagatattctttggttaatccccagagtttcaggccttttcgctcctcttttctctccttgcaggctctgtggcctcatatgtgctgacacagccaccctcagtgtcagtggccccaggacagacacccaggatcacctgtaggggaaataatattggaattaaacctgcttaatggtaccagcagaaaccaggccaggcccttgtgcaggtcatctatggggatagcagatggccttcagggatctctaagtgattctccagctccaactcggggaacatggtcaccctgaccatcagtggagcccaggctggggacgaggctttcctctcaggtgtggggcagtggcactgcacacagtgacagaggcagacaaggaagtaagacacagaccccttccccatctgtgctgctgtcgtcctccagcccggcaacactgtggacaaagccatgagcatgcatgacccagttcacctggatctgagacccccagtctttacttccttcagccctccaggcaggctgtgcagagggggcatccagaatggatttagggctgaggtgaccaggatgtattggggttttgtggactccactgtgattcagggaaattagatcttccaagcagaccaaggtcaatatcctcagttatctctggatttccataggtggtgataggccagtccttggccgaaatgtcctgaatcagtccccagaactgcccagctgaggctcctgtcattctctacagaaaaactagtggagtggacactgtgggatcctcccagatcccctcttatgagctcacccacacagcactcctgggagcttctggcagctcagagctgttcggtgcagaaatctgcctcccccaggtttatgtctcttctcagggaggtttggtttcatgactgcctgtggccaaggtctcaagactcttcctcagtataacaggacctgaaaatcctccaagatccatagctccttgtagggctgactgaagcctcaatatgtgtcagggcctccttctgcctggtgttgcctccatcactttcttaatcatctgtgtatgatattctccatctcagagtctgtttccagggaacccaaactaagatcaccagccatccccaacacgggccatgagggagctgaagaggccactgtacactagaaagcatcagtttactcttaaattaccactgcgagtctgcaaatgcccagcgagacctgagtggttttttttttcatttgtgtgaaatgaaaagggagactgacatgccagatgctctgggttctgagggagagttggagtcagatcctcctgcaggaatccaggggcagcaggagcagcctcgccccatgcagggaccacagatgcacccagagggtgagctgcaggatggacactgcccacctccaatctgtatatcctgtgcaaaaaaatcattgttttcaccccttcttcagcctatcaaagttgtcacttaaaaagccactacatctcatcctgtgaacaggaaacccatccacatctccatcagccacataatctccacataaagattcttcaaaaaatagtaataatagctgtgaaaaagtatctaaaatattgcatgacaatcatacttagattacatatgaaaatggcactatttttgatatgctaggtaaataaaatatattatttgaagtcatttaccttcttctctttatatgtctaatgtggtgactagactagcctagtgggattcccattaggctcatcatactgtgattgaacagtgctggtctgcacctcttcaggttaacaggggctgtggagtgacctggtgcaggaaatatcatctccatccataggatatcagtgtgaacccagggagaggcactggtgcaagagagatgagaacaggggtgtggagtaggggactgagccttcactttgagccgaagaagtttcctttcctatcctcaatcctgaacaagagggatttctggacttctttttgttttcaagtttgtgccccttcagatttggggctgtctggaatcctgccaggggacaccgagaaaaaataggagtctcacactgactgttgtatttcatctgctggggccatcccaaaccactgcgtacaatttcctttcctggtgctcaaatagctgctccacgcacttgttgtggtttcagagatgaatctgggtgggaagacaggacagtgtatgttataatatttaaatggaacccaaatccattaatatttattttaatatggaacattaaaagagttttgtaataggcaatgggaaaaggtaaaaaagataaaagctttttgagaaaaaaaacaaaaacaaacttatagaatgtctatgtgtcttcagtgttgcagggttgagagagatcagctttatggtgccccatggatgtgctgagatggggaaaatcaagaaagaaggaagtatgtaccactgtgactcaacaaataaatcaaagtaaaatggacttaaatctttcaataagtcattcacaataaatatcactctggtgcacacagaaatgcctgttagcaaactttcccttccccctggccatgtctccatggatcacctgtgtgcagagtggctccggtcagtgctctgtgttccctccacagggctccccacaacatgtgccctgtgtggatgtgggtgcatcgcctggggtggctgatgtgctccagggattcgatgctgcagatgcctcagcaccaagggtgggggtgggaatgggacaaggctgcagctggggagaccaaggatcaaccacacacagcaggggtttccacggggtgagcagcctcatttcctgacagtagagcgagcctaaaggtaggtgccaggcagtggtatctgtggggtggcccaggcctggagggtcacagagacacaggcaccacacagcagagacactgagggccaggagctcactcaggtgagggacttcagcagatctttctctcctggtacaaagagatcaagttcctaccatcagaatagacaaacaaggactttaatctcctcagctgagccccactgtccagggaagaagtctctgagcccaggcccaggtgagagtgggatgaggagaggagccaggacacagattttcatggatgccccgccctcctctgaggcagagcggataagacagggctgggggcatacccagtgcttgagtctcaggaggcagcgctctcgggacgtctccaccatggcctgggctctgctcctcctcaccctcctcactcagggcacaggtgatgcctccaggaaaggggcctcagggacctctgggctgattcttagtctcctgctcctcaggctcacctgggcccagcactgactcactagagtgtgttttttcctttttccgggctctcgggctcagtctgccctgactcagcctcactcagtacccgggtctcctggacagtcggtcaccatctcctgcactggaaccagcagtgacgttgggcattataactatgtctcctggtgccagcagcacccaggcacatgatttatgaagtcagttataggctctctggagtctctgatcacttctctggctcccagctctggcaacatggcctccatgaccatctctgggctccaggctgaggacgaggctgattattactgcagttcatatacaagcagcaacattttccacagtggacataagattgattctcaggctccaagtctggccagtgagcttctttgagactccctgggatcccagcagtgacactgatcactattgctgtcccacacatcccaagtgatgaggaagtaagaccaaaaccctcctgagattcctgacttgtgtcctgacaccagggctgttgggattcctgtctttccttcaagattgttcaaataagcagtgacagtcacttccatgtgagatatgagaagaagaataattccatatgaaccaaatccacgaagcctacactgaagcctgccaagttctctgcagtccagcgcgatgaagggagcattttcgtgggaacttttgggaatatgaggggagccaggctcagctatgggttccagagacaaagctcctggatgtttctccccggccttggtccatcacctgctacctctcctcactctttccacagacactgccccaggctaagcccccacaggaccctaagcctattcctgaccctgagctcagcccaggtgatgcttcaggagatgggatcctgagaatgagccccaacatctctttaacctaaggtgtggggtcatgagacacctgttagccataagacacctgtcccccacctgctcaggagacagtggagcaggcaacagtgcagagagaaccagcaggagccaggccaggccctgcatccaaagcaggccccagtccccacagattctccagctctagcctgtggtacagcccccactttctgcaggctgaaatgggcttctcaggatgggcaggccatgatgggggatggcagtgtgtccacaggacacagccctgctgcctgcctgaccctcatgccccctccttccccaccctggttaatctccaccagaaagggcccaggttcagaactcaggacacctggatcagctcctggacttgcccccactgctctctgttctcctgagccacttagtctcttttggcctcagtgttacctgctgtgaagtgaggaggcttatactgaactgaggaagctcttttcttcattcaaaattaaaagacagaaaaacaatgaaagtcatgtaaattaaagcctgctgaggggatgtcatttaatgggcttcagtgggtttcagacgtggaacttcttgtcttttctctgcagggattccaagacaggggctcaaaagagcttgctttctgtatggtgggaacagcggtccctagctgagaataagcaggagattcccagcttcatcaggaaggcagactaggctagtgtagaaatcctctccgtacaaactctgagaggtgttgaataaaataaagataaacataatttcatgttttcatggtgccgatgatggtgatgttagctcacaactaagctgcagtgcctggaacatcaggaaatcacagtgaatcacagctgctcttattgggtgggaggtgcaccagtttgatgcctaagtacatagaaagcctgggtccctgtaggatggcacatgcatctctctggactttgaaagctttgcagaagagcttcagttgactcactctaattagtccggactgaacaaaaccactagaggagggcatttcaaccctgagacacttctatagccccaacttcctaccctgcgtgtgcgaactctctgtgctgggctgggcagggcagattgggtcaccctgcacagaatggggctggactgtctggtcctcaacttctgaggtgacaggtgctgtggaggcacgtggaagaaaaaagctcctgggctgagtctcctccaccagctgggggcagcagagctgcagccaggagcagtcaggattaaggctggggctgcccagctggggcaaagagaaggccagcctggcgttcaacaggtgtccaagaatcagtcttcagactgaaagtgagtgcagttcatcctatcccctcaggctgcagtgaccattctctgagggtcagactcatacagtgtcaccccaggacactgacagaagcccggcacagtgaaggcctcacctgggaaatgcagctggaggaggctgggaccaggtgtcaactggggcagcttactcaggaaggggatttctttggagacatcccaaggttgaggtgctctaggagggggcacagcgtgaggtgacggggctcccagggcccgggttcttcacccaggatggctgtctgagcctcctgccactctcagggccttgtccctctcagtccagcagcaacctggggagctgagccctctgtcctgggcacttccagatacaccatacctcacttccttctgcctcaccttccagctccaggcggactctgactcagggggaaactcctgtgctcaggggagtctcgggtgggtggggtgaagcatttgggatcctgatcccttcatggggcatccccagcatccttaaggagacactcttcagagggacagggcttctcacctgcctcagctctgaccatggggctgtccacactcagtgacaggacactgaccagggatctgactggagtgaccaggaacctggctggggcaaccagggaccacccaccctctggagctcacatgctgtgcagagaccatgaccctgggaccccttcagagaccatggggcctgaagttagattttcagtccagtgtggttttctcctgctttttgcaagtttacataaaacattgatgagaaaaacatacataaataacagacgagctgagggtgccaattgctaatctcttgtggcaatgaggggtgatgtagcaggagcagcaccatggctgaaatgagaccagaggccctgttgactccacaggggtgtgtggttgcttaaatgacccaactattcccactgaataatcagcaagtgtcccaatgacacagcacagcatttagatgaaatgaacaagaggggactgagtctgagggaccagggggaggaagatcatgggtccctgggccacctgctgctgagtcaggtgtcagcaagatctctccgcagagcccagctcagcccatggccaacctcctggaaggtccacagctctgctgagcctggcccaggacagaccccaggtcagcgaggtttgggacagtggtcatgagattaattcccagaaaggtgactgtgatcacagggcttgaaggctgcagctgattttctaatctgagaccctgcttcttcctcctgttgcctgtgctgccctcacagctggtttgagtgacatctctccaggaggaatcgcagaggatgtaaatttgcataaacgccaaacactgactgcccccaaaagctggagagggaataagagaggcctggggagcccagctgtgctgtaggctcaggaggcagagctctgaatgtctcaccatggcctggatccctctcctgctccccctcctcattctctgcacaggtgctgcccctaggctcagtctccacagaccccaagttgagcctgacctgaatcctgagcaaagccctgccactgcctctgggggggattcctggcaatgcgtcctttgtcctcaagccccctctcctgtcttttcttgcagtctctgtggcctcctatgagctgacacagccatcctcagtgtcagtgtctccgggacagacagccaggatcacctgctcaggagatgtactggcaaaaaaatatgctcggtggttccagcagaagccaggccaggcccctgtgctggtgatttataaagacagtgagcggccctcagggatccctgagcgattctccggctccagctcagggaccacagtcaccttgaccatcagcggggcccaggttgaggatgaggctgactattactgttactctgcggctgacaacaatctcacagtgacacaggcagatggagaaatgagacacaaaccccttgccatctgtgtcaccttcttcctccagccccaggaggactgtggacaaagccacgaacaggtctggcccagtacacccagatcagagactctgaggcctccttccttccagatctctacggaggccctacagaaggtggatcaataataaattcggggttggcaggtccagtaggtcctggtgttttctgggctggagtgtgacttggggaaaaatgacttgaatggaagtacagtcagtgggagacatctattgagtggtgatggtcccagtatttccttgtgtggtgactgaacctagggcagtgccactactctgtggcccaaatgccctgggttattcctctgagttccccgtgtattattgagatgctccagcccccactctcatggtatcctgatctgaagaatcatggccagtgcccattgcagtgtctccatctaggtgccattttcaggactcatgcatccagcatccaaacaaggctgtgtgggagaccgtgacttgtcacagctgttccccactggaaaatgccactgagctgcagagaactgctctcccagtgatgttcccccttcacagtgtggttcaggtgcaatgcctgcctggtccctagattttaatgccatgttttcatttaaaataaccacgaagtgtctcttgctgagcgctccggtgtaacacattcccagtcatgcctctcacaattttctttctgacaaaatttcctgaaaccctattgcaatgaattctccctctcagagtaggattgcagggagttcacaaattaacaaacaaaccaaatactgtctagaagaaagaggatcaaagaggagagagctgcacagggagcgcactctggagtctgcagatattcatgagcaccgatgagcatgtgcatgggaggaaaccttctgtgatagagaaaataaccattcaaagacatttgaggaaacactccatagagctcacacacacatccatgtgcacacacatgcacaatcagaatagtgcctgttcctccgctccatgaagaaaggcccgagttaaagtgggtgagatttaccagtgagaagagctttgcctcagtactggggaaaacattgccctagacaaaaggcatctctggtgttaactaagaaagtgtacggcccctgtgctgatgcccatgtcaaagaccatcacacgtattttaaccaactagcccagagttgtcaccaagagtttgatcttacaataattctgcaatgaacatccctattcagactccttggagttcacctatgaagattaccatagaataaatctctagaagttgaattgttaggtcaaaaagaagtacgtttgtaattttcactgattattctcagattcctattcacgggggggttgtaccaatttacagtgccagccataaatctttgacgtgagtatgctgttgaaagtttgggtttttgccaacatggtagattaaaattttgttgtcttgtaacagtgttattttggatttctcctattctgcttgaggttgaacattttctcaaacatttcagggctcttatattttaggatttagtgagcttttttctaaaatggccaggtaaggagggttttagcccctgtgggccaagagtcaactttgaccatattatgagggaacttataactccagttacaatgtaaccatttaaagctataaaaaccactctcagctctgggaccacacaaaacaggtggcaggccaggggtggccacaggatgtggtttaatggtccctgttttgtagggtcatttgaagtttaaaaatttcaccagcatatattttaggtggagatctttttgtgggtaatactgtatttcaccgcctatagtggcctgagatttctctctagataagaacacacttttcttattttttggatggattttgggtctatctgtgatagccctgtgtcataaactcataacttttgtgtccgtccttttactgtgatttttgggagtgtgacagtatatcaggaatacactatccagggtggaaaatcagagagagggggaggagcaagtgggcaaggaagcttgtaccaaagctggaatatccactgcagcaggctcagagaaaagggtcctaatatcagcatttgactgaagccaaaaccacaagagaccatagaggttctgaggatgacaaataaaaacatagtttaagttttaatgcattcattatttttataatccacaaaaattctaaaactcagaatttaacaatgggataaggaaaagagtttgagatgttaaacgataaagaccccaaggaaagttgccaggaaaagaacaggacctttttggtggaactatgtttatgctgtaaattaccctcttctatatgtctatatatatatttaggtataagagaacatctcatggaacacccttcttcaccacagtcaaagatcaccctcacccaaggagggaaccgaaagggaacgtcaatatgagacagaaaacataatgcacttttgtataaacattaggagagtctctatttgcatatcaaatgtggatgcttaatgttaacattggaaatagtaggttaatatgcatgtgaggtgagttttcttttgactatttctgtctgtgatttatctttcttaatagggacatttctgcccttagaacaacttaacttgtgatattttttgttctattatctgtatcagctctgttttttttttttcaaacagtggcaaagatatcccatgactaatgattaataaattcaattaatgggtatttaaattatttcaagagtggacagttgtgacttccccacatctaactcacagatgtcgctgatgctgactcactcttctcttccaatcatagcaaataaagtgggagctttgacttttctgaagacccagatgacaacaggagagaggaggtgaaaccccctaaagctgttatcctttaaaccctcaggaggaatcatcctggagaaacacccacacttgagttggattatacctaaatgagagtttggtcttagagttggtgctgagttagttcaggatttgggttgttgggatggagtgaatgcgctttacaagtgaaaaatacatgagtttttgggtccataggttggagagttcttggctgaattgtgtcccccagagttcatacaatgaagctctaatgcacggtgtgtgactgaatttggagagaatctttaaagaggtgattcagtgaaaatgaagtcatgagggtgggttcttatcgaatctgactggtgttctcgtgagaagagaaaatttgcacacacaaaaatgagacactcgagatgagcgtgcagaggaaagaccgtgtgaggactcagcaaggaggtagcgacccgcaagccaaggagagaggcctcagtgaaaaccaaacctataaacactttcatcttgactccccagcttcagaactgtgagaaaataagtgtctgctctttaggccagcaggtctttggtatctcattaaggtagcactagcaaatgaaaacaaaagggaccccaaagaccttggatgcgggaggaggaggagatggagcagggtgcaggaggtggggcagggaggggctggaagttcaggctctgaggtcatctcctgggtggaatcctgactccactcactgctgtctggggacttggggaaaaacaattaaccgcccaatattaattccatagtaaagatcgggccttgagcacaggattcctcatcttccttttttatatgatgaaagtcttcttgaggtcatgcttgtaaaacactcagcaatgtatctggcatacactatggtctcagaagtggttattatgaattttctagtgatatgtagaggatgacattggtcctgtgggcagagggggcactgtggaccttggtttgaggactctgaaagacaccaagtccgctggtagtgctcaagagcgaagagcatcacagatgcttcctcccaggccccttctattgggtaaaatttactctccactcctgacacccatctggtccttcttctgaccttagcacattatcagtttgaagacttaaggctcagggctcagatgggagctaggacaggcacactggggaatgaggagtagatttgcattcactgctcatcagagagcccacccaacaaggatacaagaataaaagaagtagatttgcatgaagagcctctccttcccatgataagagaggcctgaaggtccctccccagccatgggctcagagacagagctatgtggcatctccaccgtggcctggacccctcccttgctcaccctcctccgtctctgtgctgcctcccagggctcagcccccaaaggaccagagatcagactggccctgagcttcagctcagcacagggagtgatgcagagtgtggggctctgggaatgaccctcatcctcataattaactctcctgtcctctcttgtaggctctgtggcctcctccatgctgactcaggagccagtagggtctgtggccctgggacagtcagccagggtaacctgccagggagaaaacctaagaagccatggtacaaactggcaccagcagaagccaggctaggctcctgtgcaggtcatacatcgacaaaataaccagccctcagggctcccagaccaattctctggctccaagtcaggaacacagccaccctgaccatcactggggctcaggttgaacatgaagctgactattaccatcactcatgggacagcagtgctactcacctcacaatgacacagacagattgggaagtgagatctaaagaccttcactgtctgtgtcaccctcttcctccagccatagcaggactgtggagacagccatgagcagggctggcctgggtcacctgcatcgaagtcctccaagctgcccttccccccagctctccaggtagtctctgcagagaatgagtcaggataggatttggggctggcagaaccaggctgtcctgctgttatttggaatggatgtaccttggctcaagatgacctgagccatcttactggaaggacttactggaaggacggtaagagggagacagctcctgagtgctcatggtcactgaatttcctcctgtgtgttgactgaacccaatgcagtgcctctactctgtggcccaaataccctggattatttttctgaactgcccgtgtttaactgagaccctcaagccccagctttgtgcatcctgatgttctgaacatggaagcctttcacagtgtgcactgtgacatccctcagattcccgtttcaggacttatgcacccaccatcctcccagggctgcagggaggccctggcttctcacagctctccccaccagaaactgccatgcagtacagagaatagctttgctcaaagaattgcccatttcagagtatgtttcgggggcaatgactccctgatgccttaatctgaaagtcatgctttaatttaagaccctgaatatcaaattgaagtgccttctagctgaacactcaattgtaaaacattcccagtcacacactccacacttctttcctgagaatatatcctgaaaccctattgcatggaatcctccctctcagagtaggattccagggaacttaaaaattaaaaaaaaaaacaacacaccagtctagagggaaaaatattgaagaggagagagttagggagttgcacaaggaaagaactctgaagtctgcaaatatgcatgcactgaagagcacttgtgtgtaaagaaactccctctgaaagagaaagacccttgagggaacactccaaagagtgtgcatgcgtgcgcacacacacacacacacacacacactccagtcacagaggaaaggcctgagttacagagcatgaggtggactcatcagaagagcttcggctcagtattggggaaaatgtcggacagacatagggctactccactgtcaactaagaaagtgtagaagcaaactgggaaaagttaagacagtttccaagtaactttactgaatccaaaaataaaagaccaaaatagagaagaaaatgcaaaaggattataaactcaacaaagaaaaattcacaatgattggcattctgtcaatatttcttgcaagcaaaaaagaaaatatatgctttaacacagagaaaaatgaatcaatccaaagtggccaaaaattgcacacatgatagaccttgtaggcacgaattttggagcaattctttttttttttttttttttttttgatggagtctcactctgttgccaggctggagtacagtggcgcgatctcagctcactgcaacctccgccacccgagttcaagcgattctcctgcctcagcctcctgagtggctggaactacaggcatgtgccaccacacccagctattttttttttttaatttttagtagagacggggtttcaccgtattggccaggatggtctcgatctcttgacctcatgatccacccgccttggcctctcaaagtggtgagattacgggcgtgagccaccgcgccagccttggagcaattcttataactcttttctccttcctcatgagaatggaggatctattgaatgtgttaagtggagaaatggaaagcataaagcaagatgcaagttaaacttttagaaatggcccctaaatatctgcattgaaaaaatacactggatgagactcattgcagattagaagctgtgaaggaatagatgagtgaacttgaagatatggcaatggaagttatgcaagatgaagcacaaaaaaagtgaagagagcatcagtgagtttcaggacatcttcaagctgacttactggttataattaaagacatgaagggagataacattggtggggggagaggaaaggtagaaaagccatttaaaggaatcatggccacaatttcccaaatttggtgaaagctagaaacccactactccaaaaagcttaacaagtcacatacacacacacacacacaaacacacacacacaaataacacaccaccaacactcaccataatgaaattgctaaaaacctattataaagacatacttttaaaagtagccataaagacatggtatgtacagatgaacaacatcataaaaagaacagatttctttttctttttaaaattttcttaaacatctgtgggtacagagtaggtgtatatgtttgtgggatacatgagatattttgatacaggcattgccatgtgaaatagtcacatcatggagagttgggtttccatcccctcaagcatttatcctttgtgttacaaactactcaattacactatttcaggtattttaaattgtacaattaagttgctgacatgttatcaaatagtattgatgtaactctgacatgctatcaaatagtaggtcttattcattctttctattttatttacccattaagcatcccctaataagagcagatttcttcttagaagtcatgcaagcaggaggcagtggagctatatttataaaatattaaaagaaaaaacttactaccaaaacccatccacagactcaatgcaatccctatcaaaatacaaacgacattcacagtagtagaaaaaaactctatagttggtatggaaccacaaaatcccctgaatagccaaagcaataccaagcaaaaagcccaggctgaatatgtcacattatctgaatcaaaatatactacaaactacagtaaccaaaacaagatcgatggtattggcttaaaatcagacactgagactaatataatggaatagaataccccaaaataaattcatatatttacagccaactgatttgcagcaaaaatgccaaaaacatacgttgagaaaatgacatacttttcaataaatggcgctgagaaaaactggatattcataggcagaaccttgaaactagacttttatctctctccctatacaataatcaactcaaaatttattaaaactccgaaatataagacccaaaactataaaactactagaagggaacgtagagaacacaggggaagttcttcaggacgttggtctagacaaaaattccatagctaagacttcaaaagcacagggaacaacacgaactagacatatgggacttcattaaactgaaaatcttctgaaaagcaaaggaaacgatcaacagagtgaagacaacttctagaatgagagaaaatatttgcaaactattcaactcaaaagggcctaagatccagcataagaaaataagacaaggagctgaaataactcatcagcataaaaaacaaataatacaattaaaaagtggataaatgatatgaatagacttttcacagtcaaagacatacaaatggccaacaggtatatgacaaaatgctcaatatcactaatcatcaggggtacgcaaatccaaacctccatgagatatcatctcatcccagttggatggctatcatcaagaagacaaaaaaataacaaacactggtgaggatgtagagaaaatagaagacaaaaccacatggtcatctcaacagtcacatcaaatgttttcatgcgaggaaacattaccatttgttgtttttctagtcttgctagagcatcataaaaagataagatttgtggtgccactattggagaaaatgttattacatgcaaagactctggctatcccacaccaaactacatgaacacttactgttaaatgctaaaagaggccaggcacggtagctcacactcgtaatcccagcactttgggagaccgaggcaggcggatcacaaggtcaagagatccagaccatcctggtgaaaccccatctctacaaaaatacaaaaattacttgtatttttgcacggtggcacacacctgtagtcccagctactcgggaggctgaggcaggagaattgcttgaacccgggaggtggaggttgcagtgagccaagatcacgccactgtactccagcctggcgacagagtgagactcaggcaaaaaaaaaaaaaaaaacctaaaagattacaattctgcatttccaaatgttctggtggtcagagaccacttccttgacaagtggtgagtacggggatctgatgggataggtggcatttaggcaggtattgggtgaagaatagtgatatacacaagaaactttcaaagagaaaaacacacggaagttggaacacagaagagaacataatatgtctgagaaataaggaaagtccagactcactggagctgagtgagaacaagaaaaatggcataagccatgtatttctctctggatatctcatcaaaatattgtctcctccccaacacaccacccatgtgaattataaaaatgcccgtttttaatttttgtttgcatgtcgtgacagagtcaagcacgtgaatcaagctgagtttgatgagtccagggctgttaagctccagacccaggtggcctcagaaggacttggtggaacaagggcttgttgtcaaaagcagaggaagtgagattttccattgtggcttagaccagagattcttaaattccagtggacacacaaggccccttaaggatctggttaagatgcagatgcagcctcagcagttctggatgtggccccaaattctctgtgtccggcaactcccaggtgaggctgctgctgctggtcctcccaggaccacactttgagtggctgaactcttattcacccacctcactcaagccacgggtgagactcacacaaggagggcaccttctagaagcacaggtcacttctcactcctccccttgtgtcttagatcctttcctgttactataaagaagtacccaaggctgggtaatttatacagaaaataaaagttttatttggcagacagttccaatggctgcagagttcaaaatgtggcatctgctcttgttgaagacctcaggctgcttcctgtcatggtgaaaggtgaaggcgagccagtgtgtgctgaggtcaatgaggggaaggaagcaagagagaaagggaagataccagtctcatttaaataagcagctcttctggaaacagaggaaattcactcaccccaagtgagggcattaatctattcatgagagatccactcctatcaccctaaaagctcccattaattcccacccccaacactggggattcaatttcagcataagatttgcaagggatgaagatcaaagccatagcaccctgaggcttggccacacacttgctcatctccacatttgtcccttccttcaggaccgggatcctgactgctctgactcagtctccgtctacctcatggacacctggcagtcggtcatcatcggttttgctgaatcagcagcaacattgggggtaacaattgtgtctcctggttccaccagagacagagtagagacccacacagctgaagtgtggggtcaaatattaaaactaagagacataagattgattctcaggctccaagtctgacaagtgagcttctttgagactccctgggatcccagcagtgacactgatcactgttgctgttccacacatcccaagtgatgaggaagtaagaccaaaaccctcctgagattcctgacttgtgtcctgacaccaggtctgttcttccctcccctagaataaaacatctcttaagcacaaggctgaagaaatgtggcctcctcctttctcccacagctggtcaaagtggatacctgagagaattggctcactgaggcctcttgggaacaaaggctgggttcctgcctgtgatctgtgtactgagacacattccggacctgcccaggaaaggcaagtatagatgatgtttagttgtcacagagtccaagtagggacaattcagcggtgtcttcttgggacccctgcctctggctattttcatctactttataatgggccagggccattatttccaacttgtcatatcctttttctcctttcctcaccaggtaaggaggtggaggacagttgatgagggctggcttatgagttaccccaggatgcaaatgactttgaagtcaagcccatgtggggtcaagctcagtctataaccagggtcttttgagctctggaggagccaggcatcccagccatcaaagaggtcttgcatttgctaataaatcctcttcttccaacccacagcttatcttggctgcctaccctcatctctgtcaggaagcaatccttcgttgtttaacaccaaattattcttacttggtcagtttaaaagtcccttcctcagaaaggtcatctgtggcctgaagacaaagtgagaaggctttgctgcattttcatttggaaccttacattgccccttctgcaatgttctaaccacacatggcacatatttacaggacagcgtgataattcacttttgaaaatacagaatgtgctcatggaacaggacaatgtcatacttttggggcctgatgagcatgtccttttcacaggaccccccagagctgcccatgcatccagaaggtaccattctactctatgcaaaacgatggggcatttctatattgcagtttcttagggttccttagaaagaggccacccccaacacagagctgcacaccttgtgaccacttactgtcaattcctcaatgctgtctccaagtctcaccatgcacaagggaggaacacagagaccctggattcctagagacttgcatttcttggatgaacaaatctggggtttggttggtggcagagagctcagggctcatgtgtgagcatcacctgatgcttcctccagggtcagagtccagcccctaccctggaaggatgaaagatattgtccacagaagtggtataaaggtaacagcatcgaggacggagctgcctcttgaaatgggctattgctttgcacaacgctggagacctaaattatgttgactataatggaagagtagtccctgcggatggcctctaattgggtggaagaaagcagagggtctgcgtctgagagagcagcaatgggcagattcagcacaggcatgggcagagcagcaatcaagggtacctgagcagcaatggccccgggagaggcctggcacctgccggaagtgacgttggagacagagaaacatctaagacttaaggcttctctttctgtgcaatcccccaccccacagtttatgtgtcacagatattggcacctccttactgtaaggggtcatatgaataatacagtcctcaggggcatgggttcgaggggcagccaggtttatcctcgaagcccacttctgttacctgcagctgtgtggctgtaagcaaggcatttaatctctcagaaaaccatcctaatgagaggttaagaacctctgagaaaaaaacttagacaagaattgacagtaattcttcactattgaggctgcagggatgtaacttaatcatgtttgtaaagtgcataacacagaccctgacatgccccagctgctcctgagttggcagcaattattcctgacatcactcatgagaattggacctggaatggggatggagggaaggcagtgcagagggtttcagagggttaggaaaagagagactttaatgatttaaaatgaaggcctaggagtggagacaagcgtcctgggacattctcctgccaactctcacaatgtctcagagactgttccaaggtgaagtctactagagagctaagggaggagtttgcagaatcaaggtttgcaatgtcatgcatgagggggcagagagtcagcgggagggaagacagctgagctcatctgaagggtatttatggttttctggccctagagtccttggccatccctctatgaccagggcctcagataagcagagagcttatctgcttctctcctccaacgatagttcctggttatcctgagcccaggtcagtgcagctgtggcccattctctcctctttgtgctcagtggactgacctggaggaaacagtaggaggttcccctgctctctgtccccagggtcctttcctttcagtggcaccagcccagccctagtgtccatccatctgtgcctgcccagtcaggcctccatgctgccccctgtaatggccacaggtcaaaaactgattgtcagtcttgagcagattgtcctgactctttctgcaaaactgagcctctcacccagcaccaggacgtcacaagcaaggccagctgtaggaaggcaagtaggggagtaacgtgcatcacagagtctggacaagacaaagtagttctgctgggacacatcctggtgatgtttctcaggatggttcaggtccctgcaattgcaggcccagagaacaggactgaaggctggaagatgtgctccctttctcctgtacacaaaacagtgccatgtgtgcatgtgagtaaatgcatatgcctgtgtgcttgtgtgtgtgcacctgtgtaaatgcatatgcctgtatgtgagagagtgtgtgtgtaaatgcatatgatgtgtgtgagtgtgtgcatgtgtgtaaatgcatatgcctgtgtgtgtgcatgtgtgtaaatgcatatgctgtgtatgagtgtgtgtgcatgtgtgtaaacgcatatgcctgtgtgtgtgcatgtgcatgtgtgtaaatgcatacactgtgtgtgagtgtgtgtgcatgtgtgtaaatgcatatgcctgtgtgctggtgtgtgtgcatgtgtgtaaatccatatgcctgtgtgtgagtgtgtgtgcctgtgtgtaaatgcatatactgtgtgttggtgtgtgcatgtgtgtaaatgcatatgcctgtgtgtgtgtgtatgcatgcgtgtaaatgcatatgactgcgtgtgagtgtgtgtgcatgtgtgcaaatacatatgcctgtgtgctggtgagtatgcatgtgtgtaaatgcatatgcctgtgtgtgcatgtgtgtaaatgcatataccttgtgtgtgtgcacatgtgtaaatgcatatgcctgtgtgtgagagagtgtgtgtaaatgtgtgtgctgtgtgagtgtgtgcatgtgtgtaaatgcatatgcctgtgtgctggtgtgtgcacatgtgtgtaaatgcatatgctgtgtgctggtgtgtgtccatgtgtgtaaatgcatatgcctgtgtgtgagtgtgtgcatgtatgtaaatgcatatgctgtgtgtgtgtgtgcatgtgtgtaatgtatatgcctgtgtgtgtgcatgtgtttaaatgcatatgctatgtgtgtgtgcatgtgtgtgtgagtgtgtgtgcacgtgcatgtgtgtgtgcatgtgtgtaaatgcatatgctgtgtgactgtgtgtgcatgtgtgtaatgcatatacctgtgtgtgagtgcatgtgcatgtgtgcacatgtgcatgttagtgttgccagggagtgcttcaagtatcgaatgtcccaaattcacaacttttctattttcctcacttacctcctccctgacacatgcttctcagttaagtgagttcatatgcgcaaggcctacaaacaggcaaggcatgggccatagtcagtgctgagtcagtgtcatcaaatattgttatgcttatatagaaccttgtccagggtgggccaaatgtatgcccctgtcttgtcctgacagagcagcagaaagggagactgagacaaaacaatggccagggccctggcaacacggagacaccttcccactcctgtgagcttcacagacaaccctgggtatgggattcctgtcattcctttaagattgttcaaataaacagtgacaatcactctcatatgatatatgagaagaagaagaattccatataaaccaaacccatgacgcccacactgaagcctgccaagttctctccagtcgagcccaatggagggagcattttcatggggacttttgagagtatggagaagacctgaggaaaccaggctcagctgtgggctccagaggcaaagctctgggatgtctccccatggcctagacccttcgcctgccacctcttctcactctttgcacagatgcttcccccaggctaagcccccacaggaccctaatcctagtcctgaccctgagctcagcccaggtgatgcttcaggagatgggaccctgagaataagccctaaagtctcctcaacctgcaggctctgtagtctcttaaagactcaggtacctccagtagagttggccatgagacatctgtccctccaactgctcaggagcaggcaacagtgcagagagaaacagcagcccaggccaggccctacactcaaagcagcccccaatccccacagatcctccagcgctaacctggggtacaggccccacctctgcaggctgaggtgggctcctcagcatggctaggccatgacgggggatggcagtgtgtccatgggacacagccctgctgcctgcctggccctcatgccccgtccctccccaccctggttaagctctgccccaaagggcccaggttcataactcaggacacctggatcggctcttggacttgcccccactgttctctgttctcctgagccacttagtttcttttggccacagtgttacctgctgcgaagtgaggaggcttatactgaactgaagaagcacttttcttcattcaaaattaaaagatagaaaaacaatggaagtcatgcgaatggggggatgtcatttaatgggcttcagtgggcttcagacatggaatttcttgtctttcctctgcagagattccaagaaaaggactcgaaaagagcttgctttctatatggtgggaacagcagctgccagctaagaataagcaggagagtcccagtttcatcaggaaaacagactaggctagtatggaaatcctccctgcagaaactctgagaagtgtggaatgaaataaacataaacatgaaattaatctgccaacgatggtgatgttagctcacaactaagctgcagtgccagaaacatgcggtgattgcagtgaatcatagctgctcttactgggtgggaggtgcaccagtttgcttcctaagtgcatagaaagcctggcacgcacgtctctctggactttgaaagcttggcagaagagcttcagttgacttactctaattagtcctgacggaacaaaaccactagagtagggcatttcaaccctgagacacttctgtagcaattgctcctgccccacatccctgcactgcatgtgtgacctctctgtggtgggctgggcagggcagattgggccacactggcacagaatggggctggactctctggtcctcaacttctgaggtgacaggtgctgtggggtcacctggaaggaaaaagctcctgggctgagtctcctccaccagttgggggcagcagagctgcagccagcagcagtgaggagagaggctggggctgcccagccggggaaaagaggaaggcctgcctaaggttcaacaggtgtccaagaatcagtcttcagactgaaagtgaagacagttcatcctatcccctcaggctgcagtgaccacgctctgagggtcagactcatatagtgttactccaggacactgacagaagcctggcacagtgaaggcctcacctgggaaatgctgctggaggaggctgggcccaggtgtcagcttgggcagcttcctcaggaaggggattccctggaagaagtcccgaggtcaaggtgctctaggaggggcacagtgtgaggtgacggggttcccagggcctgggttcttcacccaggatggcggcctgagcctcctgccactctcagggccttgtcctgccctgtccagcagtgtcctggggagctgagccctctgtcgtgggcacttccagatacaccctgcctaccctccctctgcctttccttccagctccaggcagactctgactcaagggcagctcctgtgcttaggggagtctcaggtgggtggcgtgaagtatttggggccctggtccctgcatggggcatcaccagcctcattgaggagacactctccagagggatggggattctcacctgcctcaggccacagccctgaccccggacctgtccatgctcagtgacaggacaataaccaggaacctggctggagtaaccagggaccacccatcctctggagctcacatgctgtgcagagaccatgaccctgggaccctgggaccctgggaccctgggaccctggaaccgtgacagaatccatggggcctaaagttagattctcagtccactatggttttctgctgctttttgcaagtttacataaaacattgatgagaaaaacataaataaataacagacgagctgagggtgccaattgcttatctcttgtggcaatgagggaatggtatagaaggagcagcaccatggctgaaatgagaccagaggccctgttgactccacaggggtgtgtggttgcttaaatgacccaactattcccactgaataatcagcaagtgtcccaatgacacagcacagcatttagatgaaatgaacaagaggggactgagtctgagggaccagggggaggaagatcatgggtccctggtccacctgctgctgagtcaggtgtcagcatgatctctcggcagggcccagctcagccccatggccaaactcctggaaggtccacagctctgctgagcctggcccaggacagaccccaggtcaacgaggtttgggacagtggtcatgaagtcaattcccaagaaggtgactgcgatcacagggcttcaaggctgcagctgattttctaaccagagatcctgcttcttcttcttcctcttgtcgcctgtgctgcccccacagctggtttgggtgacatctctccaagaggagtcccagaggaagtaaatttgcataaacaccaaacactgactaccctaaaaagcctgagagagaataagagaggcctggggagcctagctgtgctgtgggtccaggaggcagaactctgggtgtctcaccatggcctggatccctctacttctccccctcttcactctctgcacaggtgctgtccccaggccctgctccaggccctgctccagtcttattccccacagatcccaagttgagcctgccctgaatcccgagcaaagcccagacgcagcctctgggtgcgactcctgggaatgggtcctttgtcttcaagccccctctcttgttcttccttgcaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagatgaggctgactattactgtcaatcagcagacagcagtggtacttatcccacagtgacacaagcagacagggaagtgagacataaacccctccccctctatttcatcctcttcctcctgccccaggaggactgtggacaaagccatgagtaggcttggccaaattcacccaaatctgaacccccaggctgcccttccctccagccctccaggcaggcactgcagagtagtcagtctggagtggatttgtgcctggcaggccaggctgtcctgtgtttctttgcctggggtttgagttgtcgatggagggtctgactggaaagacagacacagggagacatccatgcaggcatgtccaaagggacatggggaactctcaggtctcagttgaatgcagtcattgttgtatcctctgggaaagcattcctctagtgcatctaagacctccagacccacagagcctgagatcaggaggagagaatgttaaatttttgctaatggaccactgaagacatttttgagtggagccactacaatttactccttgattctggactcatggatcctgactgtgggagaaacagcaccatctattgggcactgatgcacagaacatgccctatcctggaagacattgtccagccctacacatacttgccacttgcctggtgcagtaatggtgtctccaagcagtcattaaaccattcatataagccatatgtctcagaatgtttgggacaagagtaagaatcttgattgccagaagaaaaggcccatagccctttatttgcagtgaaatgaattccttggtcagaacctcctgtggaataccatcatgatgggtgcgtcattctgtaatccagagacaacagttttggcagaagcattgctgtcaatgaaagcaaatcctctgtagaataaatgtcaattctagtaagaaaaaagagctattcctgccatgatggaagagtgcaaacgaaattaatattaagcaggcccctggctgttttccacagagaaagtcatcctatagggatctctgtgttagtctctgctgttggcagatggtcactcagcagtggctacagccaggccagctccagttagtggaaatcgacattgatgagcccatggacagcctccatccctgccaccatgggcgcttttttttatggagcccactgggcattgacaagagtggttgagggaggctgcctgatgtccacagaacaagtcaccctactcacctgattagcaaaatcacttcattttcacagaagacttggtgagtattgacatatggaaaaaattctcttactttctgcccaccggaggaggtctattcacacatctctccccctgacgtatttgtgatcaatattctcattgtgtctctctcaagtccctgaacatccttgagcatctttcaagaccctgagtcacaacctgtgaattaggaacctctgcccatctcttggcaggtgacatgagccaattgcactgcttaaaattctactttaatgagaatgttcctccaacactgctgttcagggattctcagaggccaggtggagtactagcactgtccacaccagtagtggctgcatgtcctgcagaaaactctgtaaccccagcctaagtgcctcctcctaggcagctgatctcagggagcccctcaggacgtcaaggctgtagggtgagaggaagacatggtgcagggctccggtcatgtctatttggccaactcttcatgaaacttacttgggcctcgtgacctagtccctcaagtcacaaatacatccctgccatgtgattgaggagctgctggaaatggccaaccgggactgtggttcagaccaaacctagcatactggcaacttgggtcgcatggtgagctgtgtggccacaatcacacagagcctctgctgaggcccaggagcgttcgcagtctttctcaaatggagctttctgctcattcaaaaaaataagtagagggaggctgggaccccaggaccacttagaccacgcacatgatcttgtctgattattctgaatccttgcatgctcagctatgcattatggtaaccaagccacagtgtctttggcaataaaatgccactacttggcccccacctaacctgggatcccctcaaccacatcttgctacccaaaacaggtttcacctccactgagagaaatttatttttatattgagaagatgaaagattaattatttcaattgtgaaaattttataggacagtaatgtgaaaatattttaaaagacactttacgaagagtgaaagaccttccattaaaccactcaatatatgacactgtaattggcctacccaaaccctaagttcagctccgggttgggaccttctgggaatggacccttcatcctcacgccctcctctcctctcctctcctctcctctcctctcctctcctctcctctcctctcctctcctctcctctcctctcctctcctctcctcttctgtcagccctgtgcctcctatgtgcagagacagctggtctcagtgttggtggccctgggactgacaatcatgagcacatactctggagataaccttgagataaacatgcattaaggaaccagcagaatccaggccagtccatggtgctggtcatctagtataacagcaactgaccctcagggacatctgcccaattcttaggcttcaactcagggaacatggccaccatgaccattaatggagcccaagcccgggaagagactgactattgctgaactgcagataataacagtgggagcagctggcagggactcatagtaacacagagagacagggactagccacagaactgtcccatctcggcctggctctcattctcagctgccctgtgagcagctgaaggtcaggcctcagggtcaggcgtcctctctggtcttaacctggcccctgcagggctggtgattctgagcagcttctccatcctctcagggcctgcatgtgtccagtgagaagtgagtggacagggggaagctggttggagctgcaggaacctctgtcaggtttgtggtgtacatgaaaggtttaggaatccacacaacatcacatggccccagatgtaatcacacatcacacaggggaggaaagagctgtcgcagagggtacagtcctgtggaatttctcttttccttgggtataagcagcttagtggaagctccagaggctgtgtctcctctggtttccagatgagttcagttgacctccgcattctaaaggggtgcctgaggcctgaggaggactggagacccagccccttttggccccagggccctttctgtgctgacatttcacagaaactgaagaggaagaacagacactacctttcatcccacctggggactgtctttggggcacgctgaactcccatggcccccaaagtcccatcaccttccccaggtaggtcagacctgactggatgtccctctagtgccctgatagtgtggattttatctttgggctctgggctgctttctgaggagctcactaagaacccttgatgccaagtccaggacctgcccctctgctccatgtcccaggggctgcaagcatgacgggaaggtcctgctgggtgaggatggtgcccttttccagaagagatgtctgattccagtctctagggccaggtttgttgggctttttttctcacttggaaggtctcagtctctttattaccttctttaaaagtacaattggtttaatcgtgaaatcatgtgcatgcactaaagtttacagactatggtcatcagcacatatgtacactctttctggatgggacaactgtggacacggccatactggggtctctgtctctctcattatcacaagggaggataccaacagctctctcctatgcagaccgtagtcatgtttcccaattgcacaagaatgtctcttacagttgtttaatttccttcccagccaggacgcttaagtttcccatgctgatacttggttgctatttctctctgatccaacatttttcaaacagtattgcttgcaacccaaggcttatgaaacactttaccaaaagttccacaagaaaagctcaagtttctcatgcaccgttggaccaggttcattgcgtgcagtaggaccttgctcaagtgatgagtccatttgatgttttcaccatcaaggtgaagggtattatgacttttgggcactgagttgatagaaggaagacagcagctgatgatggccctgcccaccgatgtgtgtgtgtgggcaggacctatcgatggatttagaagttgagggaactgtttattctgcagatggaatttccagcactgaatctccaccaaccagacactagcactcagcaggtgctctgtaagaagaagcccttcactgccaatcacggccattacacaggtgaaggagaggatgatttttaacagccattgaccctcacagtaaactgaggtcaaaactctggtacacaaagtgactttgagagaacaggctgaggaagcaggttaattagtagcagaaggctttgccgagagcaggaacaaaacagggttggtgaggaactagtgatgccatggtgtggaaggaacaaggcctgtaccaggagcaggaaggggcatgggaaagaccacactgccacatgtgatgagtcagcacatggaaggcacagcaaatgttgcacaaaggtttttgtgtaataacctggcaaacagctgcttctctatcaagattgatgagtcaaaaaatgttactgatgcattgctgtcacatgtgaaggtgtgtgaagaatggtgacattcaaggaaacctgttctctgcagacacctacccaccagtacagcagacaccccagctatgccaagggctttgtcttcctctggggtaagagcctgggaacaacaagttggcccctgaaaggggtgccccatcatgcgctcttcatggctgagttaagtggggagctcccagagaactttccagtaaatggtcaatctgtttgttctgggtgcattgagcatgacccaggatcaatggaagtgacagaagcttaatttccccaaggctgcaaggcgggcactgggaggacggctgaagcagtttagccaccaccccctagtggctccagccccaggtaagcagggacagttgaagggcctgcctgagcccacctgtgtctaattagttccagcatcagcagctgcatcctgtagaccaccaaggagtgtgtgtgcccagcccctcacagatcacctgagcataaacaggaaattctccttcttacacctgactgcaccacacatctgccccttgctcttcatttacaagacgctatcacatcagacacggactgatctgagtcccgggttccctcaggtttctgctgtcctctcagatccccacacacaaaagactcttcaccacagggcgttgagccagctcttcccctaacactgcctcttacaggttactcttctccaatatgatgcgggtttgatttcagtgtttctacatatatacttttgtattttattgggtaagctgagccccttgtacctgatcttgagtcaggcaggggccacacagagaagaggtgttcctcccctgggaccagcagtcctcggatcagggcatcagggacctgaacagcaggttctgaatccacacctagacccaggaagtccctgagcccccagcccacagtgtggagcggccaccagggggaagcagagagttacctggcaaagccacctggcgatggggcgggcctgggtgacagggagacgctgacatgcagcaggagccagtgaccatgatctcacacctggaatgaaagggtctttattttcatagagtattgtccttgtgtacttgacactcatgtagaaattctagaataggattttaccttcagctcttgcagatgctgcctctttctctgccacagctccaggcacttgacttctcacagtgccctctcctcacacacccagttgtgctaaaatggtgtccctgccatgtgcagtgtcctccctgaggtcacaggtgtcccctttatctcccctttgctctgggagcccctgtcctgcagacacagtggcttctcctttcctggctgctcctccactttcattgtccctggtctttccggactctctcctggggaagctgccaaatcatggctcttgatttcctggtgagtcacaaaatagttgctcattaacctttagttgacttaagttcttaatcattgatacattttccccaacaactgacgacaacttagttataataaacattcacttctgggggtcttggagtttgcagccccctctcattctctcatggagcaaacatttccttcgcctcctcatctgtctctgatcctgacagcatcctggagatactgaggcacagcagctatgacctacccaggagcttgcagccaaggcagaaacttccatcacctcatggatcttccagcactctgtgtgcacttgacaaataagaaattccattgtcctctaccactcaggagctgtgccctgcggtgggacctgcacctttccaaggtgtgtgttatcatctgcacagtggagatgaagagggaacctgcattgggttctggaaagtaccatctaaaaatatatttagacctgcaacagaaatctcctctctaacataaaatatttatgatcaggacacactgagaggcctagaccaaaattaagcactgccctcctgagccaggatagaatggaggaggggactggggaccccagataattccacagttaccagcatgactctatgatcacctcctggaccagatcaaagatcatcccatatgaaggacttcatattccttaggaaatacaaagtcacctctgagctctgctgtgaccaagtgagcccaggaatgaggctgagcacagtgtgatgtggagatgtctgcagagaatatggaatcaattgataaaggagatcctgtgggcaaagggtgggagggcaaggccacccctaacctctttgggtcccttggggctgagtccttctggaaaccacaaagctcctccagcagcagcccctgactctgctgattggcatcacgggctgttctctccaacaaggggttaagagagacctgggaggagcctgcccagcctcagacttgagaagcagcattggaggcacttcagccatggcctggcccctcttttccttggtctcctgactcactgcccaggtgctgcccccagggtctcacccacctgcccagccccaggcctccaggttcagcctggccatcagtctgagctcagcagggccctgtgtgtggtgggcaggatgctcgtgaccctgctgcagggggaggggctggttgggctgaaatgcccccactctgtgctcctgtgctcatgggtgccctgagagctcttttattcctggggctcactccagccctggcaagtagcaagatatcctggggttgagcctctcagtttcaaattttttatctcccctttccttcttgcaggctctgtcacctcctgtgagctgacacagccaccctcagtgtcagtagctccaggacagatgactaggatcacctgtggggaaaacagtattggaagtaaaagtgcttaatggtaccagcagaagccaggacaggcccctgtgtgggtcatctatggggatagcaggcggccttcagggatctctgagattctctggctcaaactcagggaacaggaccaccctggccatcaacagggcccaggctggggaccaggctattactgtaagatgtgggacattaggactcctcatcccacagtgacagaggtagatggggaagtgagacacaaaccccttccccatacgtgtcactcttgtcctccagcccaggaagactgtggacaaagccatgagcatgggtttcccaattcacctggatctgagaccccccaggctgccctttccacaggccctccaggcaggctctgcagaggggacatcaagactgaatttagggcagaggtgaccaggatatattgaggtttgggggactcagttgtgatttggggaaatggggccagaatggaaggtcaggccaaggtcaacatccttagttggtctctggatttccatagggggtgaaggccagtccttgggctgaatatcctgagtcagtttccagaactgcccagctcaggctcccatggcatcctgccattctctgaaaagggccctggcatgccaggtgctctgggttctgagggagagttggaatcagatcctcctgcaggaatccagggtcaggagaagcagcctcacctgacacagggaccacagatgcacccccacagggtgagctgcaggatggatgctgctcatctccaatcctcacatcctatgcaaaaaatcattcttttcacccctccttcagtgtatcaaagttgacacttaaaaagccttaagagcccactcttgtcaacagaaaacccattcacatctccatcagccacacaatctccacagaatgattcttcaaaaaacgataacagtagacatgaaaaggtatctaaaatgttacataaataattgaacttagattacatatgaaaatgatactatttttggtatgctaggtaaataaaatatattatttggactcctttactttcttctctttgtatttctaatgtggtgactagacattgggattccaatgaggctcacatcatattgtgattgaacagtgctggtctgcacctcttcaggtaacaggggctgtggagtgacctggtgcaggaagccccatctccaatcataggacatcagtgtgaacccagggagaggcactggtgcaagagaaatgagaacaggagtgtggaccatctgcttgtacaggggactgagccctcactttgagccaaataaactttttttctattttcaattctgaagaagaagactttcctggacttctttccgttttcagatttgtgccccttcaggtttggcctgtctggatcccagccaggggacaccgaggaaatccaggagtctcacactgactctgttgtatttcatctgctggggtcatcccaaactgctgcgtatcgtttcctttcctggtgctcaaatagctgctccatgcacttgtcacggtttcatagctcagtctaggtgggaagacaggatagtgtatgttataatatttaaatggaacctgaatccattcattgtttttgtttttttgtgtttttgtttgtttttgttttgtttcgtttttgagagagagagagagtcttgctctgtcgcccaggctggagtgcaatggtatgatctcggctcactgcaacctctacctcccaggttcaagcgattctcctgcctcagcctcctgggcagctgggattacaggcccccgccaccacatccagctagtttttgtattttagtagagatgaagtttcaccattttggtcaggctggtctcaaactcttgacctcaggtgacccacctgtcttagcctcctaaagtgctgggattataaaggtgagccaccacgcccgacccaatagtttttttaaaatatgaaatgttaaaagagttttgtcataggcattgggaaaggtgaaaatagattaaaaacattttaagaaaaaaaccaaaaatgtacttgtagactgtctgtgtgtcttcagtgttgcagggttcagagaggtcagttttatggttcactaaggaggggctaagatggaggaaaccaagaaagccaaaaacacacatctctgccactcaaaacataaatcaaagtaaaatggaaaaaatctttcaataaatcattcccaataaatatcactctggtgcacatagaaaggcctgttagcaaactttccctttcccctgctggctcatatccccatggatcacctgtgtgcagagtggactctgtggtccccatttctcaggctgagaaccagagactgggaaggacaagtcacctgctcatgagtgggaagggcaggattgggagcagctggcttgggttcaggactgtggccctggtcggtgctctgtgtccctccagagggtccctcccacatgtgccccgtgtggatgtgggtgcactgcctggggtggctgatgtgctccagggattcgatggtgcagatgcttcagcacaaaacgtggaggtggggatgggatgaggctgcagctggggagaccagagaccagcgccacccagcagaggtttccacggggtgggcagccccatttcctgacagtagagacaggctggaggtgggtgccaagcagagggcgctgtggggtatgcccaggcctagagagtcacagagacacaggcactacacagcagaggcactgagggccaggagctcactcaggtgagagacttcagcagatccttctctcctgagcaaatcaggtacaaaaaaaattaagttcctgccatcagcatgcacaaacaagaacattcatctcttcagctgagccctgctgtccagggaagcaaaagtctctgagcccaggcccacgtgagggtggggtgaggagaggagcccaggatgctgattttcatggaggccccgccctcctctgaggcaaaggggataagacagggctggggcagggccagtgctggggtcacaagaggcagcgctctcgggacgtctccaccatggcctgggctctgctgctcctcactctcctcactcaggacacaggtgacgcctccagggaaggggtcttggggacctctgggctgatccttggtctcctgctcctcaggctcaccggggcccagcactgactcactggcatgtgtttctccctctttccagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcactttccacagtggtccaagttcatggggaactgagaccaaaacctgcccagggccttcagacttcctccttgctctgaagatgcttcctcacccggtgcaagaggcttgctgcagcgcggccttgagaattcttctctctcagctccttccctttccaccatgaattccaacaggaaacctgccctgtggtttcccatccaggacagggacagcttcctgatgcttgtgtgctgtggtccctgaatgtgcaactcttcccagctcttcaaatgcagggacagtgacaaggagctgcctgattggtgcagtcactgcttttttcagggatgtcttcaccctacatgtatcatcatcccctacactgtgggtagaattttagcaactacattctaatggttatcgccacaactttgatcttagaaataacagtgcagtgaacatccctatgcaggctcctttgagttcctgtgtgaatacgaccataggattcatttctaaaagtgaaattgcgggtcagaaagatgtgtgtttgtgattttcacccaatgttgtcagattcccctccagagggattgtaccaattttcaatgccagctggaagtacttgttcagagtacattgttgaatgtggaaatttttgccaacgtatcagagtgaaaaatggtaccttgttacagttttatttttcagtctcccgttctgcttaaggttgggccttttcacaaatagttcagtactcttcatttttcatgatttggtaaactttataaaaaatatccagataagaagaattttagtctttgtggccagacacggtggctcatgcctgtaatcccagcattttggaagactaagacgggtgaatcgcttgatcccaggagtttgggattagcctgggccacacagtgaaccctcatctcaattaaattaaagaaaataaaaataatttttaaaaaaatcctttgtggtccaaggatcaactttggggatattacctatggacttatatcaccatttacaatgcaaacatttaaaatgataacaactactgtcagctgcagaactaatttgactccatcaaaaaaaaaaaagctaaaagattataattctgcatttccacatgttctggtggtcagagaccacttccttgacaagcagtgagtacggggatctgaagggtagttagcatttaggcaggtattgggtgaagaatagggatatacacaagaaactttcaaagagaaaaacacatggaagttggaacacagaagagaacataatatgtctgagaaataaggaaagtccagactcactggagctgagtgagaacaagaaaaatggcataagccatgtatttctctctggatatctcattaaaatattgtctcctccccaacacaccacccatgtgaattataaaaatgcccgttttaaatttttgtttgcatgtcgtgacagagtcaagcacgtgaatcaagctgagtttgatgagtccagggctgttaagccccagacccaggtggcctcagaaggacttggtggaacgagggcttgttgtcaaaagcagaggaagtgagattttccattgtggctgagaccagtttcttaaattccagtggacacacaaggccccttaaggatcggttaagatgcagatgcagcctcagcagttctggatgtggccccaaattctctgtgtctggcaactcccaggtgaggctgctgctgctggtcctcccaggaccacactttgagtggctgaactcttattcacccacctcactcaagccacgggtgagactcacacaaggagagcatattctagaagcacaggtcacttctcactcctccccttgtgtcttagatccttttctgttactataaagaagtacccaaggctgggtaatttatacagaaaataaaagttttatttggcagacagttccaatggctgcagagttcaaaatgtggcatctgctcttgttgaagacctcaggctgcttcctgtcatggtgaaaggtgaaggggagccagtgtgtgcagatgtcaatgggggagaggaagcaagagagaagacaaagatgccaggctctttttaataaccagctctttcggaaacaggggaattcactcaccccaagtgagggcattaatctattcatgagagatccactcccatcaccctaaaagctcccattagttcccacctccaatactggggatccaatttcaacataagatttggaggtgacaaagatcaaagccatagcaccctgaggtttggccacacacttgctcatctccacatttgtccctcccctcaggactagggtcctgactgctctgacttagtctccctccaccttatgggcacctggcagtcggtcatcatcagctttgctgaatcagcagcaacattgagggtaaaaattgtgtctcctggttccaccagaaataaagtagagccccacacagctgaggtgtggggtcaaaaattaaaactaagagacataagactcattctcaggctccaagtctggccagtgagcttctttgagactccctgggatcccagcagtgacactgatcactattgctgtcccacacatcccaagtgatgaggaagtaagaccaaaaccctcctgagattcctggcttgtgtcctgacactggggctgttgggattcctgtctttccttcaagattgttcaaataagcaccgacaatcacttccatgtgagatatgaggagagaataattccacatgaaccaaatccacgaagcctacactgaagcctgccaagttctctgcagtccagcacgatgaagggagcattttcatgggaacttttgggaatatgaggggagccaggctcagctatgggttccagagacaaagctcctggatgtttccccctggccttggtccatcacctgctacctctcctcactctttccacagatgctgccccaggttaagcccccacaggactctaagcctattcctgaccctgagctcagcccaagtgatgcttcaggagatgggatcctgagaatgagcgccaacgtctctttaacctgaggtgtgaggtcatgagacacctgttggccataagacacctgtcccccacctgctcaggagacagtggagcaggcaacagtgcagagagaaccagcaggagccaggccaggccctgcatccaaagcaggccccaatcccacagattctccagctccagcctggggtacagccccaactttctgtaggctgaaatgggcttctcaggatgggcaggccatgatgggggatggcagtgtgtccacaggacacagccctgctgcctgcctggccctcatgcccactccttccccaccctggttaatctccacccaaaagggcccaggctcagaactcaggacacctggatcagctcctggacttgcccccactgctttctgttcccctgagccacttagtctcttttggcctcagtgttacctgctgtgaagtgaggaggcttatactgaactgaggaagctcttttcttcattcaaaattaaaagacagaaacaataaagtcatgtgaattaaagccttctaaggggatgtcatttaatgggctccaatgggcttcagacatggaacttcttgtctttcctctgcagagattccaagaaagggactcaaaagggcttgctttctgtatgatgggaacagtgatctccagctgagtataagcaggagagtcctagtttcatcagcaagacagacaaggctagggtagaaatcctcctggcacaagctctgagaggtgtggaatgaaataaagataaacatgaaattaatgtgcctatgatggtgatgttagctcacaactaagctgcagaaccagaaacctggtgattgcagtgaatcatagctgctcttactgggtgggaggtgcaccagtttgcttcctaagtgcatagaaagcctgggtccctgtaggatggcatgcacatctctctggactttgaaagtgttgcagaagagcttcagttgactcactctaattagacctgactgaacaaaaccattagaggagggcatttcaaccctgagacacttctatagcaattgcacctgccccaccccactgaactgcgtgtgttacctctctgtgctgggctgggcagggcagattgggtcacactggcacagaatggggctggactctctggtcctcaacttctgaggtgacaggtgctgtggggtcacctggaagaagaaagctcctgggctgagtctcctccaccagttgggggcagcagagctgcagccaggagcagtgaggagagaggctggggctgcccagctggggcgaagaggaaggccagcctggggttcaacaggtgtccaagagtcagtcttcagactgaaaatgaagacagttcatcctatcccctcgggctgcagtgaccacgttctgagggtcagattcatacagtgtcacccaaggacaccgacagaagcccggcacagtgaaggcctcacctgggaaatgcaactagaagaggctgggcccaggtgtcagcttgggcagcttccttaggaaggggattccctgggagaagtcctgaggccgaggtgctctaggaggggcacaatgtgaggtgacagggctcccagggcccaggttcttcacccaggatggcggcctgagcctcctgccactctcagggccttgtccctccctgtccagcagtgtcctggggagctgagccctctatcgtgggcacttccagatacacccgacccctcctgcctctgcctttccttccagctccaggtggactctgactcaggacgcagctcctgtgctcaggggagattcaggtgggtggcgtgaagcattttggggccctggtccctgcatgaggcatcaccagcctccttcaggagatgctgtccagaggaacagggcttctcacctgcctcaggccacagctctcaccacggggctgtcctttgatcagtggcaggatctgcatggctggagggactactgaccacatgctctctggagctcatgtcttgtgtggagaccatgacctggggaccctcagaaagaccaagcagcctaaagttagattttcagtccagtgtgattctctggttcttttcgcaagtttacgtaaaacgttgatgagaaaaagtgaataaataaaggaagagttgaggatggcaattgctggtctactgtggggctgggggataccatggaaagagcagcaccacatgtcaaatgagactagagattgggatgcatccgaaatatgtgtggttgctcaaatgacaaaactcttccaactgcaatgattcataagtgtcctacagacacagtacatcatgtacataacattaccaggatggggccaagtgactcgggggtatcaggagcagggatgaaagaggagaaagatgatgcatctttggtgtacttgctgctgagtcaggcgtcatcagtgatttctcaacagggcccagctcagccccaggccaggctcctggaaggtccatagtcctgctcaatgcagcccaggacaggccacatgacacagaggtttgagacagggaccatgttgtcaatccccaggacggtgactgtgatcacaggccttggaggccaaggctgattttctgactggagaagcagacgaaggaagctggggattcaccccttcattttaagtttctcatgctgcccccagagctggcttgagggatatcccgccatgaggagtcccagagaagtaaatttgcataaacaccaaggatgcactgccccagtgggcctgagaggaaataagagaggcctgggaagcccagctgtgctgtgggctcaggaggcagagctgtgggtgtctcaccatggcatgggccacactcctgctcccactcctcaacctctacacaggtgctgcccccagaccctgccccaggctcagccctcctaagcccctggtcttaccctgaaccctgagctcagcccaggcatagcctcagggcgatactactggaatgggtttgttatcttcaagccccctctcttgtcctctcttgcaggctctgttgcctcctatgagctgacacagctaccctcggtgtcagtgtccccaggacagacagccaggatcacctgctctggagatgtactgggggaaaattatgctgactggtaccagcagaagccaggccaggcccctgagttggtgatatacgaagatagtgagcggtaccctggaatccctgaacgattctctgggtccacctcagggaacacgaccaccctgaccatcagcagggtcctgaccgaagacgaggctgactattactgtttgtctggggatgaggacaatccctcagtgacacaggcagatggggaagtgagacacaaactcctttttcatctgtgttgtgttcttcctccagcaccaggaagactgtggaccaagcaatgagcaggtctggccaagttctactggatctgagacctccaggccatccttttttccagctgtccaggttggctctgcagagggtggagcaggagtggatttaaggctgctataatcagaatttatggtgttttggggcctcatgagtgacttggggaaataagaactggatggaagatgaaagagatgtagagaaccatcacttgaccttagatttccatacgatggtgattgggtcactccttcttcaaaatatcctacatcagtcccgaaaaatacccacctcagctcaacacctgagcttccaggcttccatggcagcctgggattttgaacaggaaaagccaaggaggggacactgtggcatctgcctcaatacccttttctgagctcacccaacctcaactgctgggagcttctaggagctcagagctgtgccctcactgggaagtgctattagctccaaagaaaacttccttcctcatatttaggcccagttttgagagttttggtttgatgactgcctgagccaagaacccaaggccctgtcctaatagaggatgacactgaaaggccttccagatccagacatcccagtatggatgcctgaggcctcagttgcaaccctattgtgggtcagggtctccttctggtgggcgatgcctccctcactccttccagatcctctgtgcatgcacatctttttctcagagtctacttccaggaaacccaaactaagatggctggctatcaccaaaataaactaccatagacctgaggtggaaacaccagcgaatttcccaaatttccattgtgaacatccaaatgcccatttatatctgagtgttccttgtattcttataaaatgaaaatggagcctgacataccaggtttttggagtcctgaaggagatgtggagacagatccttctgcaaggaatccaccgaaaggggagcagcctcaccccatgcaggggctggagatgctcccacaggggcagctgtagcatggacgctaccaacctccaccctgcacatcctgcacaaacaatcactctttcacccctccttcagcttatcaaagttgacacttacgaagccagcacagctcacccttgtcaatcagactccttcaaacctccatcaaccacacaatctcaacataaagaatctccccaacataataataggaacagtagctatgaaaatggctataaaatatctcataaataattttagattgtgttcatgtgtaaatattatttttcacactttgggttaaataaaatatattactgaaactagtttacctttttattttttatgtctagtatggtgactagacagtaggattcacatgagactcacatcatgtgattgtacaatgctggtcttgtcttaccccttgaggtggcaggtgctttggagtaacctgcttcagcaagccccatctccacccgtaggacatatgtgtgaagccatggagaggcactggtggaagagaaatgagaacacagatgtggaccagctgtttatgcaggtgactgagtcctggagccctgatcctgttctaacctagatgtgtcacatccatctcaccagagaccgctgctggcctgccttagctcataactggggggatctggcagttcatgaaacatggtcgcttgatgtccagtgttatcctgtctctctcagggcccaataagacaaaaggagctgcttttagaaagggaagtaacactctactgcacatgacatggccttattccaaaaccccatgagtctacgttgggattctccagtggggtttgccatgtacaggaggtttcagttcccacagtagagtcagctggattctctggacccaacagcaggacactcacaaccctgcctgcacctgctgcagagcctcaatgctctgggcctggaaaacaatgggtgatatttgtggctcctgatatatgggttggagccacatccccaagtgtaaaatatgctactcctagacctttatagaccttgtgtctgtttcttcctggagggaattgaagggtataataacatgttctttaatttgtaggagactctcagctgctccagacaactgaagtcccaatttctgctaatacagaagagggaacagtttatttcccactcttaaaagtgcatggatctcacaaaagcttccagtaggccatgcccatcatgtatatgtgattcaactatgatatcaagatggtctgaaccctcatgatgatatcatgatagagataagagagctaatgatgctgggcagagaaagtgtgaatgtatactgtcgtccattccacctgaatgcacactgattctgatcctattctctgagggaaatagacaagacctcagtatctgcttcagtgaggtaactgtgcacctgcagccatagcattctgttcccagagatccccatctggcacagatattgctaatgccactattgcccatctgggtctgtacaaatccaaattcatcttccaggatcattcaactattgtagagatcagtccagtaaactgaaaacaaaaccccagaagtaatcacacgtactgcgggagaggagagagctgtctcagagggcacagtcttgttgaaattcctctgctccttgggaagaaacagcccagaaaaggccccaggggctgcgtctcatctgggttcctggatgaggcacaccccctactgcactgagattccacagaagctgggggtgaagtgcaaataccgtctttggttcatccttgggattttctttttatcacacactcgtcattttgtccacaatgtccaaagtttctaaagtgctgtctaatagatagaggttctttgtgcgctgaactaaaagctcttgggttggacaatggtgatgtttgcacaacatttttactgtacttactgccgcttaattacacacttaaaaatgattaaaaggatgaaacattttgttatgtttattttaccataataaaaatattgcatgctcaggaagcaaagtaattttgcaattatacaactgttaaaaatggaagaattatgtactgagcaccattttctctgttgtttatgctacaattcaactttctctctctctcactctttctctaattagcaatgatcttctgtctggtccaaggtcacacatttccagtcttccagaaatgtctgttgaatctgttaatttgttgccaggaagaatactcaaacttctcatgctcatatttgagtgttagctgtctccagccagcatttctaagccagaccctttgtcaaggcttttgaataattttgtgaaaagtacccccaaagatgacagtgttcactgttggcagcaggactgtttccatgcagtagggctatgctgggtgtgcagtggagctgtgcacactgtgctcacggggcagattctgtgctgctgactctgatccctgtgcttgggaggaccgtgtccactgctgagtctacatctgaatttgattctcaagaaaaaggtcattcatagctattggacactgagtcacatagagggacagaaggtggctgaggacaccttatctctgatgagcataaggggattagatctgctggtggaacaggaagctgaagaaacctgtggctctaaacatggaatttccagccctgagtctctgctgtccgtgcccctctcatctgtatgttcctgggagatgtggaccacgggggttagaggtgaaggggattgggaagctttcatgttctctctcaccatctcccttgcttatctaacacactcttacacacctactttattggagcttctgctctacaaacatggctgagctctaaattagagacttttgaaagtgcagacggatgcaggaactcgtccatctggagactttccaccacttgaagcagtgaacacgtctgtgcaaggctcagaatttcaagtgacaggatgttgggatttcaaagaaaactaaatctttggatgaaccacgacagaagagggaaggttcacacatttccctgctgcttgggcctcagtgaggactgactcagccagtctcaggctcctggagaccgcctgggagatctgcactaggaaaccattttcagcacagcctggggctggtaaggggcccttactctgttattctgctgcctgataattttgcatccagagaagaattaggacctgtgagtccaggaatttcaaagcccatagacaaggtcccctcattctgccgtgacagcctcagctctgctttcccaaaaaaagagcatcttcccagcatgaagaaccaggagcaaagagggagcttctcccaggggtgagcagggcagaagccaccttggtcagtgggaaggaaacatgctcagctcacatctgacccagaatgactcagtcacacctgtgcagggtcacctgtgtgtgagcatcatctatttgctccatgagaaaataccttgtgtggctcttgggtaaaatcataccataggtgacatttctctgcctattgcttcagccgatgcttttcgtgattccctttaggacactggcataaggtaagcatgtcaggtgtgggacgtattgaacaggaaaagcagaggcttctcatatcaatgctcgtggcttgtatttgggcccatacctcatggaaatgggaaaaacagaaaagaaaatgatactctgctcaaaaaagcactgagaaatgctatagtattaatatatcgacaactcatttattgagctaatgaaatattaacatagatagatcatttttatagggggatccctaatccttaaacattatattaaaaatttgtcagcttaaaggatcattaaaaggcctatgtttgattgaaacctggagtactgtactttgagtcttctaatcagccaatgagtgcagggagctggctgccctcccaggtcctgactggctccatgtccaggtagagcagcgctccccacaggcagctggaggaactgacgaggggaagctgttggcatcagggcctcaaaaatttgactcaggattttcccacgtcccctccccaagtccaggcgggttccaggacactcagaagagctcatcattatgggtctaggacttccctggtcctgctcttctttcttccttccccagtggccttaagattgtcactccctgtcacaggcccttcctttccttgtcaagtgcactccctgaattctctgctcctgggtcaggaaagctctggaacttcagggaaagcagtgctgggtgacccaatggggacccagaaagctggcccagggccagatacacaggcagcagggtgggtccctacagtgctgcctggtgggcatcaggtagaggggagtgaccaggaccaactcccctgagtgtcttcagggccaggtgaactagggagggtctgggacctggtgtggacccatgcactgacccaggaataggacaggaaactcctcagagcaaggactgtgttttcctcatgctgagctcctgaaaagcagtcttgccaggatagagtgggccagggtggatatatgttgggtgaatgagcttctgtctctgttttattgcaggagtcactacgaaggtacgctggccctgtatttgtatccagaaccagtcaaagccacctgtgagtcctgcatccctcagtaccaagccccagtcccccttcaggaccacccaccacacagagagacagacgtgcagggagcctgaggaagaacctgaaacctcctctactacatggagtgtttgtatttccatcaggaatcttgagcaccttgtgccgggtcttgaggcaggaaggggccacacagagaagaggagtttcttccctgaggtcagcagtccatgaacgaagggatcagggacttgagcagcagattctgaagcaacacctggacccaggaggcccctgagcctccagcagcccgcgtagagtggccaccagggggcagcagagagtaacctggcagaagcacctggagatggggtgggcctgggcatcagggagatgcccacatgcagggagggtcggtgaccatgacctgagatctggagggaaagaggttcttcttttcttagagtatttgtccttgacaccgatgtttacattcttctggcttcctggttctcagatctgactcttggagatgatccttatttttctgacacacattcaggcactttgcctcttcccatcgacctggcccccatctcactgtcacacatgccatcccatcctgtagtcagacgtgtcccacctccctgcctttgctctgggagcccctgtcctgcagacacagccacttctccttccctggccacccctcaacgtccactgtccccggtctttcctgactctgttctggggaacctgccaattcgtagttcttgatttccttatgagacacacaatacttactcattaatcttttgttgacttaagtttttatccattgttacattttcccagcaacagaagacaacttagttataataaacacttacttcctgggtcttggagtttgcagccccctctcattttctcatgaagcaaacatttccttcacctcctgatctgtccctggtcctgacagcaccctggtgatactgaggcacagcacccatgacctgacactagaactcgcagccaaggtagaaacttaccgcatcccatggatcttccaaaattctatgtgcccttggcaaccaagaattgcattctcctctagcacagaggagctgtgccctggaatggggcctgtacctgtccaaggcttgtgccgtcccctgtgggagatgagaagcgtccctgcattgggctcttggggacccgtcttggacatgagtgagaatgaagagggtccctgcattgggctctggcatgtgactttaaatggatttaggcctgtaccagacatctcatgtctgacataaaatatttacaatcaggacattactagagaagcagaaaaaagctaaccacctccctcctgagccaggatggaatgaaggaggggactgtggaccccagataattcccctgtcaccactgtgactctaacaacctcttaaatcacggccaacatctatcccataggaaggtctttatatcccctagaaaatacagaggaagtcagctctgagcttttccacgaccaacccagccaaggagcaaggctgggcacaacctgggtaaagatgtgagcccagaccatgggaccagtgggtgaaggaaaatcgcatgggctgagggggtgggtaagcaggggccagccctcctctctctgtttcctttggggctgagtccttctctggaaaccacagatctcctccagcagcagcctctgactctgctgatttgcatcatgggccgctctctccagcaaggggataagagaggcctgggaggaacctgctcagtctgggcctaaggaagcagcactggtggtgcctcagccatggcctggaccgttctcctcctcggcctcctctctcactgcacaggtgatccccccagggtctcaccaacctgcccagcccaagggttctgggtccagcgtgtccttgattctgagctcaggagggcccttcctgtggtgggcaggatgctcatgaccctgctgcagggtgggaggctggtggggctgaactccccccaaactgtgctcaaaggcttgtgagagcctgagggactgcacctgccaggagagagtagtgagttttcagttcaaagtctccatacaacaggaaagtcatgggccactggggctggggctgattgcaggggataccctgagggttcacagactctctggagcttgtctgggacagcagggcaagggatttcataagaagcatctttcacctgcaagccaacctctctcttatttatttatttatttatttatttatttatttatttatttttatctttgcaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcatcccacggtgacacaggcagatgaggaagtgagacaaaaacaccctcccagcctcggtcaccctcttgctccagccccgggaagcctgttgataaagccatgagtgaatctggcccagttcacctggatctgagcctttcaggttgcccttccctccagccccctccaggagtctctacagaagatacatcaggcataaatatggcctggaagggccagaatcatctggtgacttggggctgttgtgtgagttagagaatgaaggcttgggtggaaagacagacagaggcaacctctgtccactgtcctacccctggatggtcatatggtggggacagggcaagtccttagaccaactgtctggatcaggccccagaactactgcccagttctgctgaggtcctggcccccaggctgtgtggcagcctgtgattcccaacagagcaaaccagaggaatggacactgtgaagtctgcccagatcccctcctcaatgtgacccacctggcactgctgagaagcccagcagctcagagctgtgccctcactgggaagtgctgttggttgcagaaagcttcctcaagtttgtgtcccttttcagaggggttcggtttaatcaaccaagatctcaaatccttgcctcaatttaagatgccactgaatgaagggcctcccagctccagagctccctgtgtggatacctgaggcctcaatgtcaactccatcacgagtcagggtctccttctgccccgtgttgcctcccccactcccttctgaatcttctgtgcatggacatctctattgcagagttagcttccagagaaccccatctaagatggccagctgtccccaacatgggtcatcagggacctgagtaggccactataaactgaaaactctggtttctgtccaaatttgcagagtaaatgttgaaatgcccaatctgatggttccttgaatttttatggaatgaaaagggagcctgacatgccaggtgctctgggttgagggattgttggagtcagatctccctgcaggaaagcccggggcagggggagcagcctcacccctcacaggaaccacagatacacccacaaggtgagctgcaggatggatgctgcccacctccaccctccacatcctctgtaaatgttgctcctttctacaactccaaccagatatgtagatgtggcgaactacgtaaaatacggatcattcatcacatcaaaacccactgcaggacaccctggtcaacaaagaacccaatcacatccccatcaactacatagtttccaaattttccatctccagaaaaataacaataacaatatacatgaaaatcgatgtaatttatctcatacataatttcatgttgataacgtgaaaatgatagtattttgctctactgaaataaataaaatatatatatatatctgaatttatttgtcttatcttttcatatttaatgtggtgactagacactagggggtcacaggaggatcgtgtcataccactatgggacagagctcctcacaactctttcaggtgacaggtactgttgagtaacctgctgcaagcatccccatctccaccagaccatataagtgtgaacccaggaagaggcactggaacaatagagagaaaaacctgcttgtgcagaagacggtgcccttgagccctgctcctgctccatcctacgggtgccacattcatctcatggtgtaatatttcgtgccctgcctgagcttatgaccgaggggatatggcaggtctgactgtgtggttactggtgtctcatgaggttctggatgtaacaaagccctcgaatatagaagaggttgttttcaaaaggaaataattatctactgcacatgacatagacttgttgctaaatcccatgcgtctacactaggattctcctctgaagccttgccttaagcacaaggtttcagttcctatgtccagttcctctattatggtagagtctgctagtttctctggcccaatagcaggacactcactcccccacctgcacctgctgcagagcctttctactcttggccccaaaacactgggtgacacagttctcagacccatgatttatagtgtcagtattcaggcctcaggggtccctgatggcttctctggctccaagtctggaaacacagcctccatgaccatctctgggttccaggctgaggatgaggctgattattactgcaactcacataggagaggtggcactttccaccgtggtccaagttcatggggaattgagacccaaacctgccctgggctctcagcctctctcttgttctgaagatgcttcctcaccctgtgcaaggggcttcttgcagcactgccttgagaatttcccctctcccagctcctctcctttctcaccaggaagtccaaaaggaaacctgctctgtgatttctcatccaggacagtgacagcttcctgatgcttgtgtgctgtggtccctgaatgtgcaactcttcctagctcttcaaatgcaggcacatagtgagaaaagctgcctgactggtgcattcactgctgtttttaaggatgtcctcacccaaaatgcatcctcctcccaaattgtgaagaacaatctggacagaggtcattacagggagtttcaagaaactgcatcttattcaattgtgtccaccatggtctggtaaagatggccctcctggatggactattcctctgcatgtctgtcctgaagcagtgaccactgtgagaagatctgaacatgtttgtgaggtattaaggacgagaggaaactgttgtttttattattcttttgtttttgtttttgaaacaaacttttgctttgtcgccaggctggagtgcagtggcagaatcttggcttactgaaatctcagcctcccaggctctaccaatgctccctgcctcagcctcccgaagagctgggataacaggtgaccaccaccatgcctggctgatttttgtatatttagtagagacgggatttcaccatgttggccaggctggtcttgaactcctgatctcaggtgatgcacccacctcggcctctcaaagggatgggaatacacacaggagccactgcatctggcagtgttttttttatttttgctcctcctctttgcctcaatacctcaggttgctgagctggggagattttgcgtgacaggctcagtgctccctcaaaatcctcccgtctcaattcgctggggccctgtcctggaaactccccaaaagtggatggtgtccctataggttgggagtttccaaaatggccccacagggaagagttaacgtgagtccattccttcttcctcattgacatccagcatttgtaatttccatgggtgtcaatacttttgtagctgaaatctttcttaatctactaaaggtgagaatgaatttaataaatattcagacattagttgcatccaatatttaaattttatgagtcaattggtagacatagccattattatatataatttaggcttcataaactttgattaaataggttttattaaaaacaaagtaaccattttattatgtgtttagactatatcaacatgttgtgtacctgaaatatccacaagaaaatatatttcaaaaaccaaattgtatttattgtctattgttgcataaaaattgctccctaatatttagcatggtaagagaacacgtgtttgtgatcttgtcacttcggtgcatctggaattgagagcagcttagttttgtggttctggttctgggttggtcatgaagttgcagccaagctgtcaggccaggctgcattcagaggccagagcaggtggccaggcccagcctgaggggcttccactgtccctaacctgtttgtctgatgtggaaaatctcagaggaaaaggagagagtgaagtgtaaggcacctgtcccagtcccccttgtcaaaggccatcccatacctgcaccatttcttattctttcctggggcgtcataggcatagagcactgcccattcattctaacgctgtagagtattctgtagtaggattttagccatgcagcctctaatggttatcaccatgattttgatcttacaaatcacactgcagcaagcatccctgtgcagactcctttgagttcatgtgtgcatatcaccataggataaatttccagaagtggaattgctgggtcaaaaggatgtgcatttttaacttttatccattgttttcatattcccctccagttctaccagtttacaataccagccctaaatattgattggaattcattggtgaaagtgcaagtttgtgccaacctatcagatatacaaagttatcttgttacacatttatttttgatttctcctattttgcttgaggttgagcatttactcaaatatttcagtgctcattatgttttaggatttggtaaaccgtttcttcaatgcctcggtaagaggtattttagtctttgccatgcacaagacaacgttgggataatatgtatgttctgatacaccatctacaacgtaatcattaaaacatataaaaaccactatcagttctggggccattaaaaaaattggtggcaggccagggatgtcccacaggatgtggtttaacggtctctggtttctagggttatttgaagtttgaacattgcacccgcatatgttctatgtggagatctctttgtgagggacactgtaattcacctcctctaggggcctgaggtctttctttggataagaacctacctgtaccatgtgtttgattggatcttgtgtctgctcaagacagccctgtgtcacaagctcatgactttcatcttcatccatttgctctgttttgtgagagcttcagtatatcaggaatagagattcctccgaggtgaaaaattagaggcagagggaggggcaaatgggcaaggaagcttgcaccaagtcgggagtgatccagtgtaggctgagagaaaaaaggtcttaaaatcagccttgtagctgaaaccaaaaacacacaagatggttggtgttctgagcatcattaacaaatgataaatgaagttgaacttttaaatgtattgcaaatttttataaagcaagtagatcgttaaactcagaatgcaacaatggaataaagaagagagtttgagatgtttttaaaatttatttatttatttatttatttttgagatggagtctcactctgttgccaggctggagtgcagtggcacaatcgcggctcactgcaacatccacctcccgggttcaagaaattctcctgcctcagcctcccaagtagctgggattacaagctctcgccatcatgccaggctaatttttgtattttttgtagagacatggtttcacaatgttgaccaggatggtgtcaatctcctgacctcatgatccacccgtctcggcctcccaaagtgctgggattacaggcatgaactaccgtgcctggctgagtttgagattttaactgtaagtcctccaactaagttgccatgacaagaacagggatgatgagagtggaaatatgttatcctgcaaattatcgttttatgtaaaagaatattttccctcttttaggtaaaggaagcatcttctggagcaccttctctctgactatcaaagcaccattaagccacaaataaactgtaacatgaagtaggaaacaactgcccttttatataaccattgagaggtggctttatatgcataccaaaatgttgatgctcaatgctaaaattggatttagtaatttaatatgcctacaagaaattaattttctttggattatattatttctgtgtacgatttatcttagttaacttggaaatattctgctctaaaaacaactcttgttttttgggttatattttctgtatcaactatagctcttttccaaatgctgtcagagatagcccatggctactgatcacaaaattcaattttatggcatttaaattattctatactctaaattattttaaaagtgcacagatgtgaatttttcacatctgactcaaaaatgttgctgatgttgactcacttttttatttcaatcttattgaagtaggagtttacttttctggaacctggatgataacaggagactggagaggaaaccccccaaattgttttcctttaaaccctcaggatgaatcatcctggataatcacccacacttgatttgggtgatatctaaatgagagttgggtcttagagtaggtgctgagttagtttaggacttgcgctgttggaatgagttgaatgtttttacaagtgagaaagacatgagttttttggagtccagagggtggggggttattggctgaattaagtcccccaaaatgtatgcattgaagctgtaacacacaatatgtgactgaaattgtgcatagggtctttaaagaggtgactaagtgaaaatgaaaaaattagggtggattcttctcaaattggactgatgtcctcctaggaagaagaaatttgcacacacagaaatgaggcaccagaggtgagcgtgcagagaaaagaccaggtgaggattcagcaaggaggtagcaacctgcaagccaaggagagagtcctcaggggaaaccaaacccactaccacctttatcttgggttttccagcttcagaactgtgagaaaatatgtttctgccatttcggtcactaattctttcctatcttcttgtgggagctctagcaaaaacaagagggaccccaaagaccttggatgagggagaaggaggagatggagcagggtgcaggaggcggtgcaggaaggggctggaaggtcgggctctgaggtgcatctcctgggtggaatcttgactccactccctattgtctggaggacttgggaaaaacatttaacctcctaatattcactcactaataaagatgggcttgaagcacaaggctccccatcatcctattctatattacaaaagtcttcttgaggtaacacttgtaaaactctcgctaatgcatctggcatgtattatggactcataagtagcccttctgagtgatctagtgatgtgcagaaaatggcattcatgctgtgtgcaccagggggcactgtgaggtttagtctgaggcccctaatgagtccaagcccctagtaatgctcaagggcgaagagcctgactgttgcttcctatgaggccccttctagtgggtaaatctgaaaatgcacttggcccttcttctgatcttgagaaattactcagagaaggccatcaggctcagggctcagacaagaaccaggacaaatgttttagggaatggagaacagatttgcatccactgctcaccagagccacctaacgacgacacaagaataaaggaagtagatttgcatgaagagacttcccttcctatgataagagaggcctggaggttcctccttagctgtgggctcagaagcagagttctggggtgtctccaccatggcctggacccctctctggctcactctcctcactctttgcataggtgctgcctcccagggctcaaccccatattatcatgctagctgtgccaacctggccctgagcttcggctcaacacagggagtagtgtagggtgtgggactctaggcgtgaaacccttatcctcacctcttctgtcctcttttgcaggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtaaccatctcacattgacacagacagatggggaagtgagacagaaaccccttcactatctgtgtcatcctctctctccagccccagcaggactgtgaacaaagccataaacagggctggcccagttcacctgcatctgagacctccaggctgcctttccctccattcctccaggtaggctctgcagaaggtgggtcaggatgatgtgaggcttgaaggaccaggctgttctgctgttgtttagactgagtgtgccttgcctcaagatgacctgaatggaaggaccacaagaaggagatgggcagctgttgagtggtcatgatccctggagttcctcttgtgtggtgactggatctaacacaatgcctgtactttgtggcccaaatgccctggattattggtctgaactccccatgtttaactgagaccctcaagccccagctccatgcatcctgatgttctgaacaggaaagtcttttctagtgagcactgtggcatcccttggcatcccagcttcacacagcaattccccaccaaaaaatgcctttgagtgcaaagaacggcttcatgcaaagatgtgcctccttcagaatgtagttcaggagcaataactacctgatgccttaatcccaaagccatattttaatttagaatgaccttgaaatgccttctagctgagcagtcagttgtaacacattcccagtcacgcctcccacacttctttcctgacagtatgtcatgaaaccctactgcatggaatcctgcctcttagagtaggattccagggatctcaaaaattgtttagaaatgaacaaaaacagtctagttggaagagtatcaaagaggaggcagttgcacatgcagagaactctgaggtctgcaaatatacatgaactgatgagcacttgtgtgtaaagaaacacctccgaaagagaaaagaaccacgcaaagactcttgagggaacacctcacagagctcactcccacacacacccacccacgcactcacagacactcacacactacagtcacagaggaaaggcctgacttacagggcatgaggttgactcatcagaagagctttgcctcagtactggggaaaaagtcaccctagacaaaatgctgctcaggtctcaactatgaaagtgtaaaagcaaacagaaaactcaaactgtttttctgaacagtaaagtaactttactgaattcaacaataaaagacagaaatagagaatgaactgcaaaagaattctcaacccagcaggaaaaatgcacaatgccttcatcctgtcaatatttcctgcaaggtaaccagaaaatatatgctatatcaaacagagaagtgaatcaatcccaaatggcaataaaattgcacacatgatagaccttgtaggcaaggatatgaaagaaattcttataactctattctattctacttgttcttgaggatataagattgaaaaatcatattaagtggatacataaaacatataaagacagacgcaagttatactcttataaatgatccataatatgtctgcaataaaaaatacactgaatgagactgattgcagattggattctgtgaaagaatagatgagtgaacttgaagatatggcaatggcagctattcaagacgaagcacaaaagcgtaaacagagtatcagtgagttttaggacatcttcaactgcctaaattggtataatgaaagtcattaaaggaggtaagattggacagggaagagaaaaggcagaaaaacaatttaaaggaacaatgaccaaaatttcccaaattttgtgaaaactagaaacctcctattccaaaaagtttaacatgtcccaaagacacacacacacacacacacacacacagagagagagagagagagatagagagagagagagaaagagagaaagggagagagagagatacaggtgaacaacaaaatgacaagaacaaatttggtttttaaaaatttttttaattttagtggcttcatagtaggcatatatttttattgggtacacgagatgtttcaaaacaggcatgcaatgtgaaatagccacattatggaaaattcggtattcattcactcaagcacttatcctttgtagtataaactattcaattacactcttttagctttataaaatgtacagttaagttgttattgactatagtcatcctgttgtgctgtcaaatagtaggccttattgattatttctaactagttttttcttacccagtaaccatccccaggtaatagttgatttcttattagaagtaatgcaagcctaaatcagtggagttacatttagaaaatattaaatgaagaaacttactacccaaagcaatctacaaactcaatgcaattcctatcaaaataccaatgatattattcacagaaataaaaaatcctctaaaattggtataaaaccctaaaagacgctgaatagccaaagcaatactgagcaaaaagaacacagctgaagatatcacactactagaattaaaatatgctacaaactatagtaaccaaaacaggaagttattggcatgcaatcagacactgagaccaatataacaaaatagaaaacccgtaaataaatccatatatctatatatagctgactttcaacaaagatgtcaagaatgtacactgagaaaatggcacaattttcaataagtggtgctgagaaaactggatacccatctacagaacaatgaaactagacacttatcctctccacaaaaaaatatcaactaaaaatggattaaaggcccaaatataacaccccaaactataaaactactagaagggaacttaacataggggaagaacaaattctttaggacattgttctagataaaaaattatatggccaagacttcaaaagcacaggcaacaacaaataatagagatatgggacatcattaaactacaaagttcctgaaaagcaaaggaaacaatcaacagagtaaagacaacatgtagaatgagagaaaatatttgcaaactgttcacttgacaagggcctaacattcagtgtatgaaaattttaaaaaaactgaaataactcattagcataaaaaaactaataatatcattaaaaatgggccaagaatttgaagagacttttctcaatagaagatatacaaatggccaacaggcatacgagaaaaatgttgaacatcactaattagtgagggaatgagaatcaaaaccccagtgagatacaatctcaccctagctggaatggctatgatcaaaaagacaaaaaatgcaaagctggtgaaggtaggtgacttcacatttctctagtccgattctctgggaacaatgagagtgctctgtctttgctctccctctagtaactatttttcacacgcaaaaatatggaccctagtgggaaataatgcctaagaccaccaacaccttaatcatttgttcatcacactagaaatgaaactgttttccaaataatattaacatctatctgtgtctatcgccattgtgtcaatgtctgtgtgatcctataacatttagaaggcctagaagaatgcccttgctttttgcaatatgaaaatggccgatatcatagatgatatagatatagatagatagggggttgtattttgaaatgtatttctctaaaggacttctttcacttcaaatttgaaattattcttgttttaaatgtcacaaatgataaaccttatagaatgataacacaattgtatgtgttataaagtcacagggtctatcaaatgatgaaccaatcattcggtgttgaggttagtagtattttttttatttcgattctcactaaatgagaacacgttttgtattgaggggccatgccctaaccataccacatcgtggggttgctcagagactgtgaggttctgcccacactaagccagaaggagaattttattcctaagccaggatgagaattttattcctcacactgctctctgcacttgtttgtatcccataatatcccccaaaagtgagcatgagaagttcattttttaagctgcttgttcattctcttacatttaatacatgtaccaaaaattgtcttcatttttaaaataaaatgttatgctatcttgtaatctataaccctatagaataatcttgatccatacacttttgctatcacaagcagaacaagatccacttcctctctctgggataaatcccatgaccgctgctctttgagcattatttttcttaagttattttttaaacagaaatttatctgacttaccttaaccaaatgtcttttcaaagtaaccgcatttcttttaagtgaaaaattaaatagttaccttctgttatcaagaattatctgaatacaaaatatttattgtttcaactttagaaggaatgaaaaacatctacaggttactaatctaaaaatgcaggctctgggtttctatggtgttaacatgtcttccaaattttaagtaacaggtatttaaataacatgaactttgttttcaaacttagaaaatgtttcaaccttttggctgggcatggtggctcaagtctataatcccagcaatttggaaggacgagctgcgagttttgtctgatcccaggagctcaagaccagcctgggcaacatgatgaaactccatctctaccaaaagttataaaactttgccaggcatggtggcactgcctgtagtcccatctactcaagagactgagatgggaggattgctggagccagagaagttgaggctgcagaaggtaaactgtagaggctaaaacatgataaatatttaattcatcacttaaaagaaatgttggttacattgaaaagaaatttgattaatgtaattagatatatttctgtttaaaaaataattgaagtaagccctgttagcaccactgcattccagcctgggcaacagagcaaaacctgttaaagaaagaaagaaagaaagagaaggaaggatgaggaaggaaggaaggaaggaaggaaggaaggaaggaaggaaggaaggaacgaaggggaaagaaaaaaaggaagaagatatttcaagctttacagtaccagagccactctgtaatcaataagcaacaggaccaaaacagaaagagattctgtagaacagtctaaccagcgatacaattatacatttctgttcagatatcaaaaccattttcaatagtaaatatatggaatgaactccccacagagatcaagtaggatgtatgatgtgtgaatgaaattatgagttgagagtaggaaatttataaatttaatcaaacaaattaaagcattatgaggaagttgtactgctaatgtattacttggcaagctgttcagtggaacaccaagatattcttaaggaagttgcaaatatcttttaaaatgttatcattgaagtggatttttaaaaaatgaggacatgaatacctttacaaagtattcagggataaagagagaaaaataaatttagattgtgcatacatatataaaatttattttaaaagataagcttgtcttttttatcccttaaataaaaggagcagatatttaaattccttgtcttttattttaaaatttagaaaatgcttacagcttcccacactgaaatttatactaagacagataatctaatcaagggataacaaaatcaaaacagaattctcttgatgaatctattttcttgatttttaagtctcagtgtgtactctatagtaaaactatttataattgattctgctgtttgaaaatatttactgatcgtttatcttgcaccaagtgatctccagctctgaagataggtcagtgggaaaacatacaaagttgcccagcttcgttaaacttaaattctaatgaggaaaaaagaagtaattaatcagggactttaaaacaggagtgttgtgatatggcttggaattctaactgcttcctgtgcttgctgtgtggagactggattgaaaaatagggcgatagaagcttaaattcatatagaatatggctagcctgtattttgagggcccctgaaataagaatgtatagtagttctcattatttcctcaagaaatctgtgcagtagagctttggccttgggagggaagtactatagtcaccaagtggtgagggtgggaaggtgaatttgcaaataccacttggaatgagttcactttaaaggtaaagctggcaggattttcatacatgtcagatctgaaaaaatgtgtgtgcgtgtgtgtgtgtgtgttatagagagagagagagagagagagtgaaaaccagacagataccgagagagaacgacagatctgcagtgacagagagaattaaaagcggacaccacgaatattgagctcagaaactataaaatgggaggtgccattaaacagaatggggaagagcaagtttgaggagtatcagtggctccatgtggacttattgattttgacattcctaacagatgtccaaatggagaagtcagacagtgttgtgcgtagtctagtgttaaggtatcaaagaaaatatcaggaaatgagtgacacaaaaattagtaagaaagcaaagataagaaacattagtcaaagtcctgagtccagtggttatctaacacccaaaaagtagtaggccgggtgccgtggctcatgcctggaatcccagcactttggaaggccaaggcgggcagatctcctgaggtcgggagttcaaggccagcctgaccaatatggagaaaccctatctctactaaaaatacaaaattagccgggtgtggtggctcatgcctgtaataccagctactcaggaggctgaggcaggagaatcgcttgaagcagggaggtggagggtgtggtgagccgagattgcatcattgaactccagcctgggaaacaagagcaaaacttcatctcagaaagaaaaaaaagtgataaagacaagaagaaaccagcaaaaaagtactaggggtaattatcaaaaatgtcaaagggaaagtaggttaagtgttctggaattctctcaaagaaagttttgaaaaaaggagggaggaagagatcaactgctttcaatgctgctgatacataaattaagacaaaggctgaggaattatgcttcaattcatcatttaacgatatggatattgtttgtgctttgataagagcaattttcttggagtgagtaggtgagaaaccatattggagtggtttctcaaaggaatgcctgatctctggattcttaaggaaactttttattgaacagtggaggcacaaattggatttgttttaattccggggtcgggacacactctaaacatgtgcctctgcatgcctcgcttattacagctaggtatcctagtatctttcagtaacagaataatcacctgcaaaacccacacccatttaatagacacgctttacaaagactgatactagaagttgttggagaggatgtggttccacgtaatatcttatgagtcactgatgggcaagtaagctggtaaaatgtctttggaaaactcactatacctgctatactaaaacattcagataccaaacaccagaaattccatattgtaatatatttctatgagaaaaaaacaagagccctgtattaaaatatagattattattaaaaataatcacactgggtttcctgatttttttattagcaagtcagtctctgcctgattcaatagtacaacctctatctaatatatatatatagtgtttttaatcaaccactaagaaaaagtattatattttatatcaattctacattcagtgccgaaaccagcattttgtagattccagagatttgttgaataaataatgaataacttaaataagttaatatttatagtatccatatacaaataatacatcatctcagaatacaataataacgtttgttatgcagaaaatgatttcaatctcagttaaaaatattttgggcttaggagttactgtcatatatggatgctcacattgttttgtttatacgaaaatgtttgtagttaacgtacgtttttggtacttaagccttttgttcttgctgccatagcaaatagtgtgcctattaggaacaagaaccagaggtttacttcatcttaacagatttcttaataaaatacatgccatactgtttggtttaatgcataagcaaagagtcattcactccgccattgctacgtgtccctcctctaatacggctcctgaagatgttaccgatagcagaggactttgtgttcaacctaagcactttatagccctttcactttcaactaagtatgagataaaataattcagcaccaataaaacaaacacttcttaaatactgaccctttttttgagcctgtttcacgttacgcagcaagacagagtacacttctctttcccagcaaatcagtgttggcactacaccctctacactctgaaaacttgtattattggcttccttagaaacacaatttgagcttataatttagatgtcatcaaataatgtacaaaaatatgctacttccttccccttcacttctcttctcttctcttcttatcagataattgtcagttgttttttctctccaactcctttcctccgactacctgatttttaaaagactttctgcacatttccaatcttagtattgtagagacaaaatgtgtggtcaaactgcatatataggaagagctgaattatatgcaagcatttttaaatacacaattcctcctcagttttctgtgattatttcatataatcaaatgtcttccagatacacatcccaaacgagtggttgtcaagctctgctttgtggtctaatttcatcagaattatccaaaattcttatgataaatacagataaattgacataactccagatttatgaaatcaacatttccagaacccaggaatatgcattgaaaaagtgtattcctcagatgatgctgacatgatacgggatccgagtttacaatgcaaggaaaattaccttccttgcccttcagctgacccttgtatccagaggtcctcttcccctttcatattctgccctctctccttctgcacctttctcctttcctccctccagttctgctcatccagatcccaagccctcccccatggattccctaaacctcccaaatggtcagttgccactaaagttccctctgtctcatgaacaagttatgtgggcaaatgtaaaatttaagcttggaccaagctgactcaagagcggcaattacaaatttccctaaacccagaggggaccagcaaacacttgtagaagattagagatttcctgtgagtgcaaagggctcagagtgtcctgatgctgtagaccaaatcttactgtcccctccaattcatgtgttaaaatctaattccctatgtgatgggatttggaggtgaggccttggaaggtgattaagtgatgaaagcagagaacccgtgaaggggatcagtgtccctatcaaagggacggctgagaactcctcatcccttctgtcatgtgaggacacagtacaaagatggccgtctatgaaccaggaaggaagccctcaccagacacaaaatgtgctgaccactcactgctgactccagtgagtcagaggagcgcaggccacatacctgggtctctgcctccatgcctcccacagtgcccagggctgagagcagagtggcagctgctgactggggctgtgctggccacctgctctcttctacctcttgctcaagccatgctttcagccccatggctgaggccagtggctagagcaggtgccatgatgtcaggcagctccttaatgggctggtccttggcaggaccagggcaggggcaggagggctctgcagctgcctctagctccagttctgtccctgaagggggctcttcccctagtgctggcactggctcatcagctggtgctggaaggtcctggattgccgcacattgagcaggagatgaaaaagaagaaagagtcaccaatgtcagtcactttccactggaatttccacacacagaatcagcctcactgaattaaaggaattccagtccaaaaacactgcccccgcaaagtctccaaaactacaggccccccctcaccatgtgcctgtgcctggaggaactccagaggctccagcaggccaaggacaatgcacggatgtggcccggatgggatcaccagtgaggcctggcctcgtagggcctgcccagggctgtcctgtggtacctgggtgcgccttcggccagaggtgcctggggtgaggaatgagcctgcatcggcatcatgggaaaaggctgtcactctgggccctcctgaagcaggagcctcaagatatgcggatgcagcatgagaacatcttgctctcctgagcatctcccaccaagggaactggctgcgggactgtctctaggatgtgggtgcctggttaccagaattctaagttctgtgagggtatatcaccaaggaagtgaagtcacttctttaaggttccgtatcctcagccccttccttccataagacctactcagaaccccctgggctgctggctgctcaccctccccccaggccagatccttacctgtacacaggtaagtccacccagggcctgcttgtacacgtgctcctgatgtgcacctgggacctaggaatccacttagggcctgtgatccaacaggggcctaatgttgtttaaaagtaatttttattattcctacaggaaagaaaaggccttctagcaataagaagcacagtttcacatcaaaaacataaaaatgatcaaaatcttggggaagaaatgtatcaattttaatcactgaaatgttaacttttgataaatatttaagtttataaggaaaaataaaaccatgctgataaaaccacagttgtagggaatgctatagagtttctcctttgtggtttgaacacagaaaggtcccacctagttaggctcataattttctaccttaatcttcttgttcttatgattaatggaaaaaataccatgacaatgatggtgatgatggttcaagtacacactgaggtttagtgacagaaacatcaggtgctcccagttacagtgcagctgttcttattggggtgggaaaatcaatcttgtgttcagtatacacgggaagcaggagtacatgtggatatgaccacatttcactggacttatattttaaacagaagatctacagtttattcttcaaaaaataataacacttgccatgcaaagtatatatataagatgtctcaaataattgtacttacattgcatatgaaagtgatacattttgatatgctaggtaaataaagtaaattatttaactcatttacttcttccctttgtatttttaatgcgatgactagacattcagatttccatgaggctcacatcatattgtgaatgaacagtgctggtctgcaccccttcaggttacaggggctgaggagtgacctggtgcaggaagccccatctccatccataggacattggtgtgaacccagggagaggcgctggtgtaagagagatgagaacacaggtgtgaaccacctgcttgtgcaggggactgagccttcacataagttgacacttaaaaagccaccacaccccacccttgtcaacaggaaacccattcacatctccatcagccacacaatctccaagattcttcaaaaagtaataacaatagccatgcaaagtatatgatatatatcataaataattgtacttacattatatatgaaaatgatactctttttgatatgctaggtaaataaaatacattatttaaactcattgacttcttctctttgtatttataacatgacaactagacagtgggattcccatgaggctcacatcatattgtgattgaacaaggctggtctgcagggcttcaggttacaggggctgtggagtgacctggtgcaggaagccccgtctccttccataggacatcagtgtgaacccagggagaggcgctggtatgagagagatgagaacacaggtgtgaaccacctgcttgtgcaggggactgagccttcacttggagccaaagttttctttcccaggttcaatcctgaacaagagggccttctggacttctttttgttttcaggcttgtgccccttcaggtttggggctgtctggatcccagccaggggacactgaggaaatccaggagtctcacactgactgttctatttcatctgctggggccatcccaaactgctgtgtaccatttcctttcctggtgctcaaatagctgctccatgcccttgtcatggtttcagagatgaatctaggtgggaagacaggacagtgtatgttataatatttaaatggaagctgaatccattaatatttattttaatatgaaacattaaaagaattttgtcataagcaatgaggaaagaggaaaagatattcaagttattttgagaaaaaataaaaatgtatttatcaaatgtctgtgtgtcttcagtgtcgcagggttgagagcagccagctttaggttgccctgaggatgcgctcagatgggaaaaagcgagaaagcaggaaacgcgtctctgtgacctgacagataaatcacagtaatggaaataagtctttcaataattcaaacattcacaataaatatcactctgatgcacacagaaaggcctggtaacaaactttccctttgacctgctggctcatatccccatggatcacctgtgtgcagagtggactctctggtccccatttctcaggctgagaactagaggctgggaaggacaagtggcctgctcatgagtgggaagggcgggattgggagcagcagactcgggctcaggactctggccctggtcagtgctccttgttccctccacagggtccctcccacatgtgcccgtgtggatgtgggtgcactgcctggggtggctgatgtgctccagggattcaatgcggcagatgcttcagcaccaaaggtagggagtagggatgggacgaggctgcagctgtggagaccagggacccatgatgcccagcagaggtttccacggggtgggtagccccatttcctgacagtagagacagcctagaggtgggtgccaagcagagggcactgtgccatgtgcccaggcctggagggccacagagacacaggcgccacacagcagagacactgagagccaggagctcactcaggtaagggatgtcagcagatctttctctcctgagcaaatcaggtacaaaaaaattaagatcctgccatcagaatagacaaacagggactttaatctcctcggctgagccccgctgtccagggaagaagaagtctctgagcccaggcccaggtgagggtggagtgaggagaggagctcagggtgcagatttgcataaaggccccgccctcctctgaggcagaggggataagacagggctggggtcaggcccagtgctgggatctcaggaggcagctctctcggaatatctccaccatggcctgggctctgctcctcctcaccctcctcactcagggcacaggtgaggcctccagggaaggggcttcggggacctctgggctgatccttaactcctgctcctcaggctcacctgggcccagcactgacttactaaaatgtgtttcttcctttttccaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaggtcagtaatcggccctcaggggtccctgatcgcttctctgggtccaagtctggcaacacggcctccctgaccatctctgggctccaggctgaggacgaggctgattattactgcagcttatatacaagcagcagcactttccacagaggtccaagttcctggggaactgagaccaaaacctgccctgggctctcaggccccctccttgctctgaagatgcttcctcgcccagtgcaagcggcttcctgcagtgcggccttgagaattcttctctctcagctccttccctttccaccatgaattccaaaaggaaacccgctctgtggtttctcatccaggacagggacagcttcctgatgcttgtgcgctgtggtccctcaatgtgcagctcttcccagctcttcaaatgcagggacagtgacaaggagctgcctgagtggtgcagtcactgcttttttcagggatgtcttcaccctacatgcatcaccatcccctacactgtgggtagaattttagcaactacattctaatggttatcgccacaactttgatcttaaataacagtgcagcgaacatccctacgcagactcctttgagttcctgtgtgaatatgaccacaggattcatttctaaaagtgaaattgcaggtcagaaagattgtgtgtttgtaattttcacccattgttgtcagattcccctccagagggattgtaccaattttcaatgccagctggaagtacttgttcagagtacattgttgaaagtggaaatttttgccagcttatcagacagaaaaatgttaccttgttacagttttatttttgagtctcctgttctgcttacattttggccctttcagaaatagttcagtactttttctttttttaggatttagtaaactttataaaaaatatccagataaggagaattttagtgtttgtgggcaggcacagtggctcacacctgtaatcccaagcacttcgaaagagtaagacaggtgaattgcttgttcccaggagtttgagattagtctgggccacacagcaaaccctcatctctattaaattaatgcaaataaaaataaattttaaaaagaattattttagtctttgtggcccaagaatcaactttagggatattacataggtacttataacatcatttacaatgtaaccatttaaaaagataaaaatcactgttatctctgggccatgcaaaaacagttgtcaggccaggagtggccacaggatgtggttgaacggtccctggtttgcagagttatctgaatgttgaaaattccaccagcatatgatctaggtggggatctctctgtgagggtcactgtatttcacctcctgtattcggctgaggtctttccttggataagaacatgctcacatcatctatttgatgggctcatgggtttgcccaagacaaccctgtgtcacaatcacataacttttatctgcattgcttgttctgagttttgggagagctttaatatatcaggaatagactcctcctaagggaaaagtctgagggatatggatgggcaaggggtcaagaaagcttctaccaaagctggaatatccagggcaggctcagagagaaggatcctaatatcagcatttgactgaagccaaaaccagaagagaacatggacgttctgagaataataagtaaataaacagtttaaattttaaatgtattgaatattcttatactccatgaaaattctagaacggaatttaacaatgggataaggaagagagcttgagatgttaaactataaagaccacaaggcaagttgccaggaaaagaacaggacctttttagtggaaataggtttctgctgcaaattacctttcctatgaaattggtttttaggtataaggaaacatcccatggaacattcttctttcctacagtcaagatcaccctcaccccacaagggaacctcaatatcaaatagaaaaaataatgcactttgtataaccattaggagagtctttatttgcacatcaaaatgaggatggttaatggtaacattggaaatagtagtttaatatgcataagtgatgaatttcttttgactataccatttctgtctgtgatttatctttcttaatagggacatactctgttcttaaaacaatttaacttgtgttatcttttgttctattatctgtatcagctctgttttttttttcaaacactggcaaagttattccatggttaatgattattaaattcaatttatggatatttagattatttaaattatttcaagagtggacagatgtgatttccccacatatacctcacagatgttgctgatgctgacttgttcatctcttccaacctctgcaaacaaagtgggaaattggatttttctgaacacccagatgacaacgggagaggaggtgaaacccccctaaagctgttatcctttaacccctcatggtgaatctcccatccacacttgagttggatgatatgtaaatgagagtttggtcttagagttggtgctgagttagttcaggatttgggttattgggatggagtgaatgtgctttacaagtcaaaaactatgagtttttgtgtgcataggttggagagctcttggctgaattgtgtcccccagaattatacaatgaagttctaatgcacagtgtgtgactgaatttggagacagcctttacagaggtgattaagtgaaaatgaggtcatgagggtggcttcttctccaatctgactggtgttctgagaagagaaaatttgcacacatagaaatgagacactagagatgagcatgcggaggaaaaaccatgtgatgacacagcaaggaggtagccacctgcaagccgaggagagaggcctcagggaaaaccaaacccaccaacacctttatcttgactccccagcttcagaactgtgagaaaataagtgtctgctctttaggccagcaggtctttggtatctcattaaggtagcactagcaaatgaaaacaaaagggaccccaaagaccttgggtgccagagaaggaggagatggaggatggtgcaggaggcggggcagggaggggctggaagttcaggctctgaggtgcatctcttgggtgcaatcctgactccactcactgctgtctggggacttggggaagaatcattaacctcccaatattaattccataataaagattgggtcttgagcatagggctgctcatcctcctattccatatgatgcaaatcttcttgaggtcatgcttgtaaaacactcagcaatgtatctggcatacactatggcctcagaagtggttattctgaattttctagtgatacatagagaatggcattgttcctgtgggcagaggaggcactgtggaccttggtttgaggactcagaaagacaccaagtcctctggtagtgctcaagtgcgaagagcgtcacagatgcttcctcccaggccccttctattgggtaaaatttactctccactcctgacacccatctggtccttcttctgaccttagcacattatcagtttgaagacttaaggctcagggctcagatgggagctaggacaggcacactggggaatgcggagtagatttgcattcactgctcatcagggagcccacccaacaaggatacaagaataaaagaagtagatttgcatgaagagcctctccttcctatgataagagagggctgaaggtccctccccgctgtgggctcagagacagagctctggagcatctccaccgtggcctggacccctcccctgctcaccctcttcactctctgaactgcctcccagggctcagcccccaaaggaccagagatcagcctggacctgagcttcagctcagcacagggagtgatggagagtgtggggtctgggaatgaccctcatcctcataattacctcttctgtcctctcttataggctttgtggcttcccgtaagctgactccagagccagcagtgtctgtggacagtcagcaagggtaacctgccagggagaaaacctaagaagccatggtacaaactggtaccagcagaaccctgccagatgcctgtgcaggtcatacatggtaacaacaaccagccctcagggatcccagaccgattctctggctccaagtcaggaacacagccaccctgaccatcactggggctcaggttgaacatgaagctgactattaccgtcactcatgggacaacagtggtactcatctcacagtgacacagacagattggaaagtgagatctaaagaccttcactgtctgtatcaccctctttctccagccatagcaggactgagcagggctggcccgggtcacctggatcgaagcccttcaggctgcccttccctccagccctcccggcagactgcagagagtaggtcaggataggatttggggctggcagaaccaggctgtcctgctgttatttggaatggatgtaccttggctcaagatgacctgagtggaaggacagtaagagggagacagctactgagtgctcatggtcactgaatttcctcctgtgtgttgactgaacccaagacagtgcctctactctgtggcccaaataccctggattatttctctgaactgcccatgtttaactgagaccctcaagccccagctttgtgcatcctgatgttctgaacatggaagcctttcataatgtgcactgtgacatccttcagattcccatttcaggacttatgcacccaccatccacccagggctgcagggagttcctggcttctcacagctcttccccaccagaaactgccatgcagtacagagaatagctttgctcaaagaattgcccatttcaaaatgtgtttcatgggcagtgactccctgattgccttaatctgaaagtcatgctttaatttaagaccctgaatatcaaattgaagtgccttctagctgaacgctcaattgtaaaacattcccagtcacacactccacacttctttcctgagaatgtatcctgaaaccctactgcatggaatcctccctctcagagtaggattgcagggaactcaaaaattaaaaacaaacaaacaaaaaacagtctagagggaaaagtattgaagaggagagagagagtgcacaaggagacaactctgaagtctgcaaatattcatgcactgaagagcgcttgtgtgtacagaaactccctctgaaagagaaagacccttgagggaacactccaaagagcgcgcgcgcacgcgcgcgcacacacacacacacacacacacacacacattccagtcacagaggaaaggcctgagttatggggcatgaggtggactcatcagaagagcttcggctcagtattgaggaaaatgtcgccctagacatagggctactctgctctcaactaagaaagtgtagaagcaaactgagaaaagttaagacagtttccaagtaactttactgaatccaaaaataaaagacgaaaatagagaagaaaatgcaaaagaattataaactcaacaaagaaaacttcacaatgattggcattcaatcaacatttcctgcaaggaaaaaagaaaatatatgctctaacacagagaaaaatgaatcaatccaaagtggcaataaaattgtatacgtgatagatagaccttgtatgcaaaaattttggagcaattcttataactcttctccttgctcatgaggatagaggattgattgaaggtgttaagtgaagaaatggaaggcatgaagaaaaatccaagtttaacttttagaaatggtctctaaatatctgcattgaaaaaatgcactgaatgagaatgattgcaggttaggtgctgtgaaagaatagttgagtgaacttgaagacatggcaatggaagctattcaagatgaagtacaaaaaaagtgaagagagcaccagtgaatttcaggacatcttcaagctgacttacttggtataattaaaggcatgaaaggagataacattggtgaggggagaggaaaggtagaaaagccgtttaaaggaatcatggccaaaatttcccaaatttgttgaaagctagaaacctacaactccaaaaatcttaacaagttacacacacacacacacacgcaagtaatacaacaccaatactcatcataatgatattgctaaaaaactatgataaagacatacttttaaaagtagccatagagtaaagacatggtaggtacaggcgaacaacataagaagaagaacagatttcgttttctttgtaaaattttcttcaacatctgggggaacatagtagatatatgtatttgtggaatacatgagatattttgatacaggcatgcaatgtgaaacagtaacatcatggagaattgggtatccatcccctcaagcatttatcctttgtgttacaaactactcaattacagtattttaggtattttaaattgtacaattaagttgttatcgatgtgctatcaaatagtattgacataactctgatgcgctatcaaatagtaggtcttattcattctttctattttatttacccattaagcatccacaaataagagcagatttcttcttagaagtcatgcgagcaggaagctcgcatgtggagctatatttataaaatattaaaagaaaaaacttactacccaaacccatctccagaccatgaatttctctctggatatcttattaaaatattgtctcctatcaaatctctatcaaaataccaatgacattcacagaagcagaaaaaaaattctgtaactggtatggaaccacaaaagcccctgaatagccaagcaataccaaacaaaaaaccccaagatgaatatatcacattatctgaatcaaaatatactacaaattatggtaaccaaaacaggatcaatggtattggcataaaatcagacattgagactaataaaattgtatagaacacaccaaaataaattcatgtatttacatccaactgattttcagcataaattccaagaacatacattgagaaaaggacgcacttttcaataaatggtgctgagaaagtggatacccgtatacagaagaatggaactagacccttgtctctctccgtatacaacaatcaactcaaaatctattaaaaaccccaagtataagacccaaaactataaaacaactaggagggaacgtagaggacatagggaaagttcttcaggacattggtctagacaaaaattccatagctaagacttcaaaaacacaggcaacaacaaaaactagacatatgggacttcattaaactaaaaatcttctgaaaagcaaaggaaacaatcaacagagtgaagacaacttgtagaatgagagaaaatatttgcaaacaattcaactcaaaaggacctaagatccagtataagaaaataagacaaggagctgaaataactcatcagaatagaaaaccagtaatagcattaaaaagtgtacaaatgatatgaatagacttttcacagtcaaagacatacaaaaggccaataggttaattaaaaaatgcccaatatccctaatcaccggggcatgcaaatcaaaacctccatgagatatcatctcatcccagctaggacagctatcattaagaagacaaaaaaataacaaatgctggtgacgatgtagcaaaaatagaagacaaaaccacatggtcatctcagcagtcacatcaaatgttttcatgtaaggaaacattaccatttgctgtttttctagtcttgctagagcaccataaaagataagactagtggtgccaatactgtagaaaatgttattacatgcagagaatctcactatcccataccaaactacatggattcttactgttaaatgctaaaagattacaactctgcatttccaaatgttctggtggtcagagaccacttccttgacaagtgatgagtacggtgatgtgaaaggatagttagcatttacgcaggtattgggtgaagaatagtgatatacacaggaaagctttcaaagagagaaacacatggaggttggaacacagaagagaacataatatgtctgagaaataaagaaagtccagactcactggagctgagtgagaacaagaaaaacggcatgaaccatgtatttcactctggatatctcattaaaatattgtctcctccccaacacaccaccgatgtgaattgtaaaaatgcccgttcttaaattattttttgcacatcatgacagggtcaagcatgtgaatcaagctgagtttgatgagtccaggtctgtctgatgagtccagacccaggtggcctcagaaggacttggtggaacgagggcttgttgtcaaaagtagaggaagtgagattttccattgtggcttagacaagagattcttaaatttcagtggacacacaaggcccctgaggggtctcggtaagatgtagatgcagcctcagcagttctggatgtggccccaaattctctgtgtccagcaactcccaggtgaggctgctgctgctggtcctcccaggaccacactttgaatggcttagctcttattcacccacctcactcaagccacaggtaagactcacacaaggagagcatattctagaagcacaggtcacttctcactcctccccttgtgtcttagatccttttctgttacaacaaagaagtacccaaggctgggtaatttatagagaaaataaaaggtttatttggctcacaattccaatggccacagagttcaagatatggcatctgctcttgttgaagacctcaggctgcttctagtcatggtgaaaggtgaaggggagccagtgtaggcagaggtcaatgggggagaggaagcaagagagaagaggaagatgccaggctcttttaaataaccagctctttcggaaacagtgggaattcactcaccccaagtgaggacattaatctattcatgagagatccactcccatcaccctaaaagctcccattagttcccacctccaacactggggatccaatttcaacatgagatttggaggcgacaaagatcaaagccatagcaccctgaggtttggccacgcacttgctcatctccacatttgtccctcccctcatgactggggtcctgaccactctgactcagtctccctccacttcatggacacctggcagtcggtcatcatctgttttgctgaatcaacagcagtattgggggtattcaacattccacatttgtattgtttgaaaattgcccaatcttaggtgttttgttattgctacacaaacagactaagacatttactatttaatggttacatttcattctctttttatgaaattttgttgctaacagggactttctgcttggtcagaagattaacaattgtgtctcctggttccaccagaaacagagtagagacccacacagctgaggtatggggtcatagattaaaactaagagacataagattgattctcaggctccaagtctggcaagtgagcttctttgagactccctgggatctcagcagtcagactgatcattattgctgtcccaaacatcctatgtgatatggaagtaatatcaaaaccctcctgagattcctgacttgtgtcccgacatgaagtctgttgggattcctgtcattccttcaagattgttcaaataagcagcaacaatcactctcatatgagatatgaaaagaagaattccacatgaaccaaaccctgaagcccacactgaagtctgccaagttatctgcagtccagcgcgatggagggagcattttcgtggggacttttgagagtatggagaaggcctgaggaaacgaggctcagctatgggttccagaaacaaagctctgggatgtctccccatggcctcgacctctcacgtgctacctctcctcactctttgcacagatgctgccccaggctaagcccccacaggaccctaatcctagtcctgaccctgagctcagcccaggtgatatttcaggagatgggaccctgagaatgagccctaaagtctccttatcctgcagcccctgtggtctcttagactcagctacccccagtagagttggccatgagacacctgtcccccacctgctcaggagagagtgcagcaggcaacagtgcagagagaaccagcaggagccaggccaggcgctgcattcagagcagcccccaatccaacagattctccagctctagcctggggtacagcccccaccttctgcgggctgaagtgggcttctcaggatgggcaggccatgatggggattggcagtgtgtccatgggacacagccctactgcctgcctggccctcatgccccctccctccccatcctggttaagcaccaccccaacgggcccagtttcagaactcaggacacctgggccagctcctggacttgcccccactgctctctgttctcctgagccacttagtctcttttggcctcagtgttacctgctgtgaagtgaggagccttatactgaactgaggaagctctttcttcattcaaaattaaaagacagaaaaacaacgaaagtcatgcgaattaaagcctgatgaggggatgtcacttaatgggcttcaatgggcttcagacaaaacttcttgtctttcctctgcagggattccaagaaagggactcaaaaagagcttgctttctgtatggtgggaagagcagtccccagctgagaataagcaggagagtcccagtttaatcaggaagacagactagggtagtgtagaaatcctctcagcacaaactctgagaagtatggaatgaaataaagacaaacaagaaattaatggtgccgacggtggtgatgttagctcacagctaagctgcagaaccagaaacatgcggtgatgggctgagtctcctccaccagctgggggcagcagagctgcagccaggagctttcaggagagaggctggggctgcccagctggggcaaagagaaggccagcctggggttcaacaggtgtccaagaatctgtcttcagactgaaagtgagtgcagttcatcctatcccctcaggcttcagtgaccacgctctgagggtcagacacacggtgtcaccccaggacactgacagaagcctggcacagtgaaggcctcaccagggaaatgcagctggaggaggctgggcccagatgtgagcttgggcagcttcctcaggaaggggaatccctgggaggcgtcccaaggtcgaggtgctctaggagggggtatagtgtgaggtgatggggctcccagggcccgggttcttcacccaggatggcggcctgagcctcctgccactctcagggtgtcatccctcctggtccagcagtgtcctggggagctgagccctctgtcctgggcacttccagatacacccgacccctcctccctctgcctttccttccagctccaggcggactctgactcagggggcagctcctgtactcaggggagtctcgggtgggtgtggtggggcatttgggaccctggccctggatgggcatccccagcctccttcaggagacactcttcagagggacagggcttctcacctgcctcaggccacagctctgaccatggtgctgtccacgctcagtgacaggacactgagcaggggcctggctggagtaaccagggaccacccaatctctggagctcacatgctgtgcagagaccatgaccctgggacccttacagagaccatggacctaacgttagattctcagtccagtgtggttttctgctgctttttgcaagtttacataaaatattgatgagaaaaacatgaataaataacagacaagttgacggtgctgattgctaatctcttgtggcaatgaggggtgatgtagcaggagcagcaccacgactgaaatgagaccagatgccatgttgactccacaggggtgtgtggttgcttaaatgacccaaatattcccactgaataatcagcaagtgtcctaatgacacagcacagcatttagatgaaatgaacaagaggggactgagtctgagggaccaggaggaggaagatcatgggtccctgggccacctgctgctgagtcaggtgtcatcatgatctctccacagagcccagctcagccccatggccaacctcctggaaggtccacagctctgctgagcctggcccaggacagaccccaggtcagcgaggtttgggacagtggtcatgaggttaattcccacaaaggtctatgatcacagggcttgaaggctgcagctgattttctaaccagagaccctgcttgttcctcctgttgcctgtgctgccctcacagctggtttgagagacatctctccaggaagagccacagaggatgtaaatttgcataaacgcttaacactgactgcccccgaaagcctgagagggaataagagaggcctgcggagcccaactgttctgtgggtccaggaggcacagctctgggaatctcaccatggcctggatccctctcctgctccccctcctcactctctgcacaggtgctgaccccaggcccttccccaggctcagtccccacagattccaagttgagcctgacctgaatcctgagcaaagcccagacacagcctctgggtgggactcctggaaatgggtcctttgtcttcaagccccctctcttgttcttccttgcaggctctgaggcctcctatgagctgacacagccaccctcggtgtcagtgtccctaggacagatggccaggatcacctgctctggagaagcattgccaaaaaaatatgcttattggtaccagcagaagccaggccagttccctgtgctggtgatatataaagacagcgagaggccctcagggatccctgagcgattctctggctccagctcagggacaatagtcacattgaccatcagtggagtccaggcagaagacgaggctgactattactgtctatcagcagacagcagtggtacttatcccacagtgacacaaggagacagggaagtgaaacataaacccctccccctctatttcatccccttccttctgccccaggaggactgtggacaaagccatgagcaggcttggccaaattcacccaaatttgaacccccaggctgcccttccctccagccctccaggcaggcgctgcaaaggagtcagtctgcagtggatttgtgcctggcaggcctggcagtcctgtgtttctttgcctggggtttgagttgttgatggagggtctgactggaaagacagacacagggagacatccatgcaggcatgtccagagggatgtggggaactctcaggtctcagttcagtgcagtcattgttgtatcctctgggaaagcattcctccagtgcacctaagacctctagacccacagagcctgaggtcgggatgagagaatgtcaaatttttgctgatggatcactaaaggcatttttgagtggagccactacaatttactccttgattctggactcgtggatcctgactgtgggagaaacagcaccatctattgggcactgatgcacagcacatgccccatcctggaagacattgcccaaccctacacatacttgccacttgcctggtgcagtaatggagtctccatgcagtcattaaaccattcatataagccacatgtctcagaatgttggggacaagagtaagaatcttgaatgccaggagaaaaggcccatagccctttatttgcggtgaaacgagttccttggtcagaacctcctgtggaataccatcgtgatgggtgcatcattctgtaatccagagataacagttttggcagaagcattgctgtcaatgaaagcaaatcctctgtacatgccaatgctagtaaggaaaaagagctgtctctcccatgatggaagagctctaatgaaattaatatcaagcaggcccctggctgttttccacagagaaggtcatcctatagggatgcctgtgttggtctctgctgttgacagattgtcacccagcagtggcttcagccaggccagctccagttagtggaaattcacattgatgagcccattatcagcctctatccctgccaccatggccacatttttttggagtctgttggacaatgacaggagtggttgacggaggctgcctggtgtccatagaacaggtcaccctactcacctgattagcaaaatcacttcattttcacagaagacttagtgagtatttatatatggaaaaaaattctcatgctttttgcccactggaggaggtctactcacacatctctccccctgacatatttgtgatcagtattcctgttgtatctctcccaagttcctgaacatccttgaccatattccaggaccctgagtcacagcccatgaattaggaacctctgcccatctctttgcaggtgacatgagccaattacactgcttaaaattctgctttaaggagaatgttcttccaccactgctgttcagggattctcagaggccaggtggagtactagcaccgttcacaccagtggtggatgcatgtcctgcagaaacatctgtaaccccagcctaattgcctcctactaggcagctgatctcagggagccactctggaggccaaggctgtagggtgagaggaaggcatggtgcagggcttgggtcatgtctgtttggccaactcttcacgcaacttacttggccctcgtaacctaatccctcaagtcacaaatacatccctgccgtgtgattggggagctgcctaaaatggccacccgggactgtgtttcagacgaaatccagcatatcagcaacttgagtctcgtggtgagctctgtggccacaatcacacagagcctctgccaaggctcaggagccctcgcagtctttctcaaatggtgttttctgctcattcaaaacaaaataagtaggggggggggctgctcacgtgcttccagtctgggacactaggaccacctaaaccacacccacgatcttgtctgattattttgattccttgttggctcagttatgcattatggcaaccaaaccacagtgtcattggccataaaatgccaatccttggtccccacctaccctgggatcccctcaaccacatcttgctacccagttaaggtttcagcaacactgagaaaaatgtatttttatattgagagaggaaacattctttcaattgtgaaaaatttataaggcaggaatgtgaaaatattttaaaagacattttacaaagggtgaaagaccctccattaaaccactcaatatatgacactgtaattggcctcccaaaccctgacttcagctctgggttgggaccttctgtaaaggggcctttcatcctcaagccctcctctcctctcctctcctctcctctcctctcctctcctctcctctcctctcctctgctctcctctcctctcagcctgtgcctcctacatacagagacagctgctctcagtcttggtggccctgagactgacaaccatgatcacatgctctggagataaactcaggataaacatacacttaggaaccagcagatgccaggccaggcctcggtgcttgtaatctggtataacagcaagtgaccctcagggacctctgcccaattcttaggctccaaatcaaggaacatggccaccatgaccattagtggggcccaggcccgcgacaaggctgactattactatactgcagataataacagtgggagcagctggcagggactcatagtaacacagagagatagggactagccacagtactgtcccacctcggcctgcctctcattctcacctgccctctgagcagctataggtcaggcctcagggtcaggtgtcctctctggtcttaacctggcccctgaggggctggaggttctgagcagcttctccatcctctcagggcctgcatgtgtccaatgagaagtggacagggtgaaggtggtcagagctgccaggacctttgtcaggtttgtggtgtacatgaacagtttaggaatccacacaaaagcacatggtcccagttgtaatcatacgtcatgcaggggaggagagagctgtcgcagagggcacagtcctgcagaatttctcctttccttgggtaaaaccagctcagtggaagccccaggggctgtgtctcctctggtttccagatgagttgacccccacattctaataggttgcctgatgcctgacaaggactggagacccagccccttttggcctcagggccctttctgtactgatatttctcagaaactgaagaggaagcacagacactacctttggtcccacctgggaactgtgtttggggcacactgacctcccatggcccccaaagtcccatcaccttccccaggtaggtcagtcctgactggatgtgcccccagcgccctgatagtttggagtttatctttgggctctgggctgctttctgaggagctcactaagaaacccttgatgccaggcccaggacctgcgcctctgctgcatgtcccagggctgcaggtgtgaagggagggtcctgctgggtgagggtgatgcccttttccaggagagatgtctgattccagtctctagggccacatttattgggctttcttttctcactaggatgtctcagtctttttatttccttctttaaaagtacaactggtttagggtgacctgctcgggtccccttccacattgtagaagctttgttatttcactcttcacaaaaaatctcgctgctgctcactctttgggtccatgccaccttaaaaaaaaagtacaactggtttaatcatgaaatcatgtgtacacactgaagtttacagattattgccatcagcatatatatatatatatatatatatatatatatatatatactgtttctggttgggacaactgtggacaaggccatactggggtctctgtctctctcgttatcacaagtgaggatactaacagctctcttttatgcagactgtggtcatgtttcccagttgcacacgaatgtctcttatggttgtttagtttccttaccagccaagacccttaagttttcatgcagacaattggatgttatttctctctgacccaacatttttcaaacagtattccttggaacccaacaaaagttccacaagaaaagctcaagtctctggtgcacagttggaccaggttcattgtgtgcagtaggaccttgctcaagtgatgggtccatttgatattttcactatcaaggggaagggtgttacgacttttgggcactgagttgatagagggaagatagcagctgatgatggccctacccaccaatgtgtgtgtgggcagtacctattgatggatttagaagttgagggaactgtttattctgcagatggaatttccagtactgaatctccagcacccagccactagcattcagcaggtgctctgtaagaagaccttcactgccaatcacagccattacacaggtgaaggagaggatgacttttaacagccactgactcacagtaaactgaggtagaaattcagcttcacaaagtgactttgagggaacagactgaggaagcaggttaattattcgctgaaggctttgcccagagcaggaacaatacagggttgatgaggacgtagggatgccctggtgtggaaggaacaaggcctgaaccaggagcaggaagaagcatgggaaagaccacgctgccacatgtgatgagtcagcacatggaaggcacagcaaatgttgcgcaaaggtttttgtgtaataacctggcaaacagctgcttctctatccagattcatgagccaaaaaatgttactgatgcattgctgtcacatgttaaaatgctgggaagcatggtgacattcaaggaaacctgttctctgcaaacacctacccaccggcacaggagacaccccagctatgccaagggctttgtcttcctctggagtaagagcctgggaacaatcaggtggcccctgaaaggggtgccgcgtcttctgctctgcatggctgagttaattggggaactcccagagaacattccagaaaacagtcaacctgtctgtgctgggtgcattgagcatgacccaggatcaatggaagagacagaagcttaatttccttatggctgcaaggtgagcactgggaggacggctgaggcaggttagccaccgcccctgagtggcttcagccccaggcaaacagggacaggtgaagggcctatctgagcgcacctgtatctaaccagtcccagcatcagcaactgcatcctgtggaccacgagggggtgtgtgtgcccagcccctcacagatcacctgagcataaacaggaaattctccaccttacacccgactgcacaacacatctgcctccagctcttcatttacaaggtgatatcacatcagacagggactgatctgggtcccagatccctcaggtttccgctatcctttccagtccccacacagagcagactcttcactgcagggtgttgagccagctcttcccctcacaatgcctgttacaggtttacaagttactgttctccaatatgattggggtttgtttcactgtttctctatatatatatatttgcattttcttgggtaagctgagccccttgtacctggtcttgagtcaggcaggggccacacagagaagaggacttcctcccctggcaccagccgtccacagatcagggcatcaaggacctgagcagcaggttctgaatccacacctagaccccggaagtccctgagctcccagccgacagtgtggagcagccaccagggggaagcagagaatcaactggcaaagcgacctggggatggggcaggcctgggtgatagggagatgctgacatgcagtaagagccagtgaccaccacctcagatttagagggaaagggtctttattgtcctagagtattgtccttgacactgatgtaaaaattctagaatcacattttgtcttcagctcttttgcatgctgactctttgtctgacacagatccaggcacttgacttctcacaacgccccctcctccacacccagttgtgctaaaactgcatccccctcatgtgcagtgtcctctctgaggtcacaggtatccccctactcccatttgatctgggaacccctgtcctgcagacatagtggctggcttctaacttcctagctgcccctccacatccaccgtccctggtctttcccgactctctcctggggaagctgccaaatcacagctcttgatttcctggtgagtcacaaaatagttgctcattaacctttagttgacttaagttcttatccattgatacattttccccagcaactggagacatcatatttataataaacattcacttctggggatcttggagtttgcagccccctctcattctctcatggagcaaacatttccttcacctcctcatctgtccctggtcctgacagcatcctggagatactgaggcacagcagcaatgacctacctagaagctcacagccaaggcagaaacttccagcatctcatggatcttccaacactctgtgcgcacttggcaaataaggaatttcattgacctctatcactcagaggttgtgggctgtggtgggacccgcacctgtccaaggtgtgcattatcacctgtacagtggagacgaagagggaacttgcattgggttctggaaagtactgtctaaaaatagatttagacctacaccagaaatgtcctctctaacataaaatatttatgataggacacattagaggcctagaccaaaatgaaatacctccctccagagccaagatagaatggaggaggggactggggaccccagataattccacagttaccagcatgactctatggtcacctcccagaccaggtcaaaacccatcccataggagggacttcatattcctttgtaaatacagacaaagtcacctctgagctctgctgtgaccaagggagcccaggagtgaggctgagcacagtgtgatgtggggatgtgtgcagagaatatggaatcaattcataaaggagatcctgtgggcaaagggtgggagggcaaggtcacccctaacctctttgggtcccttggggctgtgcccttctcgaaatcacaaggctcctccagcagcagcccctgactctgctgattggcatcatggacccttctctccaacaaggggttgagagacctgggaggagcctgcccagcctcagacttgagaagcagcattggaggcacttcagccatggcctggcccctcttttccttggtctcctgactcactgcacaggtgctgcccccagggtctcacccacctgcccagccccaggcctccaggttcagcctggccgtcagtctgagctcagcagggccctgtgtgtggtgggcaggatgctcgtgaccctgctgcagggggaggggctggttggggtgaaatgcccccactctgtgctcctgtgctcataggtgccctgagagctcttttattcctggggctcactccagccctggcaagtagccagatatccttgggttgagaccctcagtttcaagttttttctgtccccttttctttccttgtaggctctgtcacctatgagctgacacagtcaccctcagcgtcagtggccccaggacagatgaccaggatcacctgtggggaaagcagtattggaagtaaaagtgctcaatggtaccagcagaagccagccaggcccgtgtgtgggtcatctatggggatagcgggcggccttcagggatctctgagagattctctggctccaacttggggaacgtggccaccctgaccatcaacaggacccagggtggggacaaggctattactgtaagatgtgggacattagcactcctcatcccacagtgacacagggagatgaaggagcaaaacacaaaaacctcttccattggtgtcactcttgtcctccagcccaggaagacagtggacaaagccatgagtgtgtgttgcccagttaacctggatgtgagacccccaggctgccctttccacaggccctccaggcaggctctgcagagggggcatcaagagtgaatttagggctgagatgaccaggatatattgaggtgtggaggaatcagttgtgatttggggaagtggggcctggttggaagatcagaccaaggtcgacatgcttagttgggctctggatttccatagggggtgaaggctagtccttgggctgaatatcctgagtcagtttccagaactgcccagctcacgttcccgtggcatcctgccattctcttcaggaaaaccagtggagtggacactgtgggatccacccatattccctcttctgagctcacccacccagcactgctggtagctctggcagctcagagctgtgccctcactgagaagggctgtcagcagagaaaactgtctcctccaggtttatgccccttcttagcaaggtgtggtttcataactgcctgaggtgaagctctcaagactccctttcaatatgggagaaacagaaaatcctcccagcttcacagctccttattgggatggtagaagactcaatgtgggtcagagtgtccttgtgcccggtgttgcctccctcacttagtttcacacctactgtgaaagcaaagctccatctcagagtctgcttccaggcatcccaaaataacataaccagtcatcccgaacgtgagccatcaggaacctcaggaggccacagtataccagaaagcaccagtttattcctaatgatcattgtgagtttgcaaatgcccaatgagatctgagtgtttcttgcatttgtatggaatgaaaagggccctggcatgccaggcactgtggggtctgagggagagttggagtcagatctccctgcagggaaacctggggcaggaggagcagcctcatcccatgcagggaccacagatgcacctgcagggtgagctgcaggatggacactgcccacctccaccctccacattctgtgcaaaaaatcattctttccacccctccttcagcctatcaaagttgacacttaaaaagccaccacagcccacccttgtcaacaggaaacccattcacatctccatcagccacacaatctccacataaagattcttcaaaaaataataacacttgccatgcaaagtatatatataagatgtctcaaataattgtacttagattgcatatgaaagtgatactattttgatatgctaggtaaataaagtaaattatttaactcatttacttcttccctttgtatttttaatgcgatgactagacattcagatttccatgaggctcacatcatattgtgaatgaacagtgctggtctgcaccccttcaggttacagtggctgaggagtgacctggtgcaggaagccccatctccatccataggacattggtgtgaacccagggagaggcgctggtgtaagagagatgagaacacaggtgtgaaccacctgcttgtgcaggggactgagccttcactttgagccaaacaagcttcttttcctatcttcaatcctgagcaagaggactttccggacttctttttgttttcaggtttgtgcccctccaggcctgaggctgtctggatcccagccaggggacacagaggaaatccagaagtctcacaccgaccctgttgtatttcatctgctggggccatcccaaactgctgcgtaccatttcctttcctggtgctcaaatagctgctctatgcacttgtcatggtttcagagatgactctaggtgggaagacaggataatgtatgttattatatttaaaaggaacttaaattcattaatatttattttaatatgaatcattaaaaaaatttgtcataggcaatggggaaggaggaaaagatattaaaattattttgaggaaaaaaccaaaattgtatttctcgaatgtctgagtgtcttcagtgtctcagggttgacagcggtcagctttaggttgtcctgaggatgtactccattgggggaaagcaagaaagcatgaaacacacatctctgtgacctgacacataaatcacagtaaaatggaagtaaatcttttaataaatcaaacactcacaataaatatcactctggtgaacacagaaatgcctgttaacaaactttccctttcccctgctggctcatatccccatggatcacctgtgtgcagagtggactctgtggtccccatttctcaggctgagaaccagaggctgggaaggacaagtcacctgcttgtgagtggcaggggaaggattgggagcagtggactcggtctcaggactgcggccctcaggaccaatgccacctagcagaggtttccacggggcgggctgccccatttcctgacagtagggacaacctggaggtgggtgccaagcagagggcactgcagggtgtgcccaggcctggagggtcacagagacacaggcaccacacagcagagacactgagggccagaagatcactcaggtaagggacttcagcagatctttctcctgagcaaatcaggtacaaaaaaattaagatcctgccatcagaatagataaacaaggactttaatctcagctgagctccactatccaaggaagcagaagcctctgagcccaggcccaggtgagggtggggtgaagggaggagctcaaggtggagatttgcatgcaggccccaccctcctctttggcagaggagataagacagggctgggggcaggcccagtgctggggtctcaggaggcagcgctctcaggacatctccaccatggcctgggctctgctgctcctcaccctcctcactcagggcacaggtgacgcctccagggaaggggcttcagggacctctgggctgatccttggtctcctgctcctcaggctcaccggggcccagcactgactcactggcatgtgtttctccctctttccagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactctccacagtggtccaagttcctggggaactgagaccaaaacctgccctgggctctcaggccccctccttgctctgaagatgcttcctcacccagtgcaagcggcttcctgcagtgcggccttgagaattcttctctctcagctccttccctttccaccatgaattccaaaaggaaacccgctctgtggtttctcatccaggacagggacagcttcctgatgcttgtgtgccgtggtccctgaatgtgcaactcttgttagctcttcaaatgcagggacagtgacaaggagcttcctgattgatgcagtcactgcttttttcagggatgtcttcaccctacatgcatcaccatctcccacactgtgggtagaattttagcaactacattctgatggttatcgccacaactttgatcttaaataacaatgcagcgaacatccctgtgcagcctcctttgagttcctgtgtgaatatgaccacaggattcatttctaaaagtgaaattgagggtcagaaagatgtgtgtgtgtaattttcacccgttgttgtcagattcccctccagagggattctaccaattttcaatgccagccggaagtacttgttcagagtacattgttgaaagtggaagtttttgccaacctgtcagactcaaaaatgatacctgttatggttttatttttgagtctcctgttctgcttaagtttgggccttttcagaaatagttcagtactttttcttttttaggatttgggaaactttttcttaaatatccagataagaagaattttaatcttcgtggccggacaccgtggctcacgcctgtaatcccaagtgtgttggaagggtaggatgggtcaattgcttgctcccaggagttgagattagtccgggccacacagtgaactctcatctctattaaattaaagaacataaaaataaattttaaaaggaagtattttagtctttgtggctcaagaatcaactttggggatattccataggtatgtatagcatcatttacaatgtaaccatttaaaatgataaaagccactgtcagctctaggccatacaaaaacaggtgtcaggccagggatggccacaggatgtggttgaacagtccctggtttgtagggttatctgagggttgaaaattccaccagaatatgatctaggtgggaatctctctgtgagggtcactgtatttcacctcctgtattagcctgaggtctttcattggataagaacatgctcacatcatctatttgattgtatcatgggtttaagacaaccccgtgtcacaatcacataacatttatctgcattgcttgctccgagttttgggagagctttaatttatcaggaatagactcctcctaaggcaaaagtctgagagagagggatgggcatgtgggcaagatagtttgtaccaaagctggaatatccagggcaggctcagagagaaggttactaatatcagcatttgactgcagccaaaaacagaagagaacatggaggttctgagaatgacaaataaacaaatagtttaagttttaaatgtattgaatgtttttataatccatgaaaattctagaacagaatttaacaatgggataaggaagagagcttgagatgttaaaactataaagaccccaagccaagctgccaggaaaagaacaggatctttttggtggaaatatgtttctgctgcaaattattattttatgtgtgtgtgtgtgtgtgtgtgtgtgtgtgtgtgtgtgtgtgtgtgtgtgtaaggaaacctcccatggaacatccttcttccctacagtcaagatcaccctcaccctacaagggaacctaaacaaaatgtcaatatcaaatagaaaaaaataatgcactttgtataaccattagagagtctctatttgcacatcaaaatgtggatgcttaacgttaacattggaaatagtattttaatatgcatatgagatgaattttctttagactatttttgtgaattatctttcttaataaggacatactcttctcttagaacaatttaacttgtgatattttttctattttctgtatcagttctgttttttctaaacactggcaaagatatcctatggctactgattaataaattagattaatgtgtatttaacttaggtaagttagttcaagagtggacagatgtgatttccccacatatcctatggctactgattaataaattcaattaatgggtatttaacttaggtaagttagttcaagagtggacagatgtgatttccccacatatcctatggctactgattaataaattcaattaatgggtatttaacttaggtaagttagttcaagagtggacagatgtgatttctccacatatacctcacagatgttgctggtgcttactcactcttctcttctaatcttagcaaataaagtgggaaatttgacattcctaaacacccagatgacaacaggagagaggaggtgaagccccaaagctgttattctttaaatcctcaggatgaatcaccctggagaatcacccacacttcagttggatgatacgcaaatgagagtttggtcttagagtggtgctgagttagttcaggatttgggtcactgggatggggtgaatgtgttttacaagtgaaaaatacatgagttttggggtctgcagggtagagagttcttggctgaattgtgtcccccagatctgggttgagtgacatcccaccaagaggagtccaggagaagtaaatttgtgtaaacaccaaacatgcactgccccactaggcctgagaggaaataagcgaggcctgggaagcccacctgtgctttgggttcaggaggcagagctctgggtgtcttaccatggcctggaccccctctctgcctctccttcctcaccctctacaaaggtgatgcccccaaccctgccttaggctcagcccttacaggatcctgagctggtcctgccctgaaccctgagctcagcctaggcatagcctcagggtgacaccactggaaatgtgtttgttatcttcaagccccctctcctttcctctcctgcaggctctgtggcctcctatgagctgacacagccacccgcggtgtcagtgtccccaggacagacagccaggatcagctgctctggagatgtactgagggataattatgctgactggtacccgcaaaagccaggccaggcccctgtgctggtgatatataaagatggtgagcggccctctggaatccctgagcgattctctgggtccacctcagggaacacaaccgccctgaccattagcagggtcctgaccaaaggcggggctgactattactgtttttctggtgattagaacaatctcacagtgacacaggcagatggggaagtgagacacaaatccatttttcatctgtctcatcttttcctccagcaccaggatgactgtgggccaagccatgagcaggtctggccaagttctactggatatgagacctccaggccatccttttgttcagccctacaggttggtgctgcagagggtagagcaggagtggatttagggctgctataatcagaattttcttgtgttttcaggcccctgaagtgacttggggaaataagaacgggatggaagatgagagagatgtagagaacaatcacttggccttagatttccatacgatggtgattgggtcactccttccaaatatcttacatcagtccccaaaaatgcccagctcagctcaacacctgagcttccaggcttccatggcagcctgggattttgaacaggaaaagcagaggaacaggaaaagcactgtggcatctgcctagatatgcttttctgagctcacccaccctcaactgctgggagcttctagaagcttagagctgtgccctcacaggaaagtgctattgtttccagaaaacttcctttctcatatttaggctcagttttgagagttttggtttgatgactgcctgagccaagaacccaaggccccgccttaatacaggatgacactgaaaggccttccagctccagacctcccattgtggatgcctgaggcctcagttgcaatcttatgatgggtcagggtctccttctggtgggtgatgcttctctcactcctttcagattctctgtgcatgaaaatgtttatctcaaagtctactttcagggaacccaaactaagacggccagctgtcaccaaaatgagccaccatagacctgaggtggccactataccctggaatgcatcagcgaatttcctaaatttccactgtgagcatccaaatgcccaacgatttctgagagatccttgtattcttataaaatgaaaagggatcctgaaatgccaggtgctctgagtcctgaaggagaggtggaggcagatcttcctgcaaggattccacggaaaagggagcagcctcactccatgcagggaccagagatgctcccacgggggcagctgtaggatggatgctgcccacctccatcctgcacatcctgcacaaacaatcactctttcacccctccttcagcttatcaaagttgacacttacgaagccagcacagctcatccttgtcagactccttcaaacctccatcaaccacacaatctcaacataaagaatctccccaaaataataatagtaacaaaataataataataataaaataatagtaacaaaatagtaatagtaatagtaatagattttcaggcacagaaatagtaatatagtagctatgaaaacttctataaaaatctcataaataattttagattgtgtgcatgtgtaaatattatttttcacactttgtgttaaataaagtatattattgaacctagtttacctttttattttttatgtctactatggtgactagacaataggattcacatgagactcacatcatgttgtgattgtacaatgctgatctggtcttaccccttcacatgacaggtgctttggagtaacctgcttcagcaagccccatctccacccataggacatatgtgtgaagccacggagaggcactggtggaagagaaataagaatatgggtgtggaccagctgtttatgcaggtgactgagtgctggagccctgaccctgctctaacctagatgtgtcacatccatctcaccagagaccactcctggcctgcctgagctcacaactggggggaaatcgcatttctggcaacatggtcacttgatgtccagtgttatcctgtctctcccagggcccagtaagacaaaagaagctgtttttagaaaggggagtaacactctactgcacatgacatggccttcttccaaaaacccaggagtctacattgggattctccaacggggtttgccatgtgcaggaggttttatttcccatggtggagtctgctggattctctggccccaacagcaggacactcacaaccctgcctgcacctgctgcagagccttcctgctctgggcctggaaaacaatgggtgacatttatggctcctgatacatggattggagtcacatccccagtagtaaaatatgctactcctagatcttataggccttgtgtctctttcttcctggggaaaattgaaggttataataacatcttttttttttttttttttttttaagatggagtctcgctctgtagcccaggctggagtgcagtggcccgatcttggctcactgcaagctccacctcccagattcacaccgttctcctgcctcagcctccctagtagctgggactacaggcacgcgccaccgcacccggctaatttttttgtatttttttattttagtagagatgagttttcaccgtgttagccaggatggtctcaatctcctgacctcgtgatctgcccgcttcggcctcccaaagtgctgggattacaggtgtgagccaccgcgctcggccataacgtgttgtttattttgtaggagactctcagctgctccagacaactaaagtcccaatttcagctaatatggaggaggaaacatctttgtttatttcccactctcaaaagtgcatggatctcacaaaagcttccaataggccgtgcccatcatgtacatgtgattgaactatgatatccagatggtctgagcccccatgatgatatcatgatagggaagggagagctaatgaagctgggcagaaaaagtgtgaatgtatactgttgtccattccacgtgaatgcacactgattctgatcctattctctgaggacaatagacaagacctcagtatctgcttcagtggtttaactgtgcacctgcagccatagcattctgttccaggagatccccatctggcacagatattgctaatgccactattgcccatctgggtctgtacaaatccaaattcatcttccaggatcattcaactattgtagagatcagtccagtaaactgaaagtgaggaccccagaagtaatcacacgtactgcaggagaggagagagctgtttcagaggccacaatcctgttgaaattcctctgctccttgggaagaaacagcccagaaaaggccccaggggctgcgtctcatctgggttcctggatgaggcacaccccctactgcactgagattccacagaagctgggggtgaagtgcaaacaccgtctttggttcatccttgggattttctttttatcacacactcgtcattttgtccacaatgtccaaagtttctaaagtgctgtctaatagatagaggttctttgtgcgctgaactaaaagctcttgggttggctaatggtgatgtttgcacatttttactgtacttactgccgcttaattacacacttaaaaatgattaaaaggatgaaacattttgttatgtttattttaccataataaaaatattgcatgctcaggaagcaaagtaatactagtttaattttgaaatcacacaactggtaaaaatggaaagaaaagcaccattttctctgttctatatgctacaactcaactttctctctctctctctttctctaattaacaatgatatcctgtctggtccaaggtcacacatttccagtgttgcaggaatgtctgttgaatctgctaatttgttgccaggaagaatactcaaacttctcatgctcatatttgattgtcaactgtctccagccaacatttctaaaccaggatcctttgacaagacttgtgaagaattttgtaaaaagtaccccccaagatgacagtgttcgctgttggcagcaggactgtttccacgcagtagggctatgctgggtgtgcagtggagctgtgcacactgtgctcacggggcagattctgtgctgctgactctgatccctgtgcttgggaggaccgtgtccactgctgagtctacatctgaatttgattctcaagaaaaaggtcattcatagctgctggacactgagtcacacagagagacagaaggtggctgaggacaccttatctctgatgagaataaggggattagatctgctggtggaacaggaagctgaagaaacttctggctctaaacatggaatttccagccctctgtctctgctgtccatgcccttctcatctgtatgttcctgggagatgtggaccacgggggtcagaggtgaaggggattgggaagctttcatgttctctctcaccatctcccttgtttatctaacacactcttacacacctactttattagagcttctgctctacaaacatggctgagctctaaattagagacttttgaaagtgcagacggatgcaggaactcgtccatctggagactttccaccacttgaagcagtgaacacatctctgcaaggctccaaatttcaagtgacaggattttgggatttcaaagaaaactaaatctttggtgaaccacgacagaagagggaaggttcacacatttccctgctgcttgggcctcagtgaggactgactcagccagtctcaggctcctggaaacctcctaggagatgtgcactaggaaagtcttttcagtacaacctggggcaggtaagtggcccttactctgatattctgctccctgataattttgctttcagagaagaacaaagacctgtgattctgggaagttcaaagcccccagacaaggtcttctcattctcccgtgacagcctgagctctgcattcccaaaaggaggagcatcttcccggcatgaagagccaggagtagagagggagcttctcccaggggtgagcagggcagaagccaccttggtcagtgggaaggaaacgtgctcagctcacatctgacccagaatgactcagtcacacccgtgcagggtcacctgcatgtgagcatcatctatttgctccatgagaaaataccttgtgtgactcttgggtaaaatcataccgtaggtgacatttctctggctattgcttcagccaatgtttttcaaaattcactgtaggacacttacataaggtaagcatgtcaggtgtgggatgtgttgaataggaaaagcacaggcttcctgtatcaatgttcatggcttgtattcatggccataactcgtggaaatggaaaaaaaaaaaaaacagaaaagaaaatgataccctgctcaaaaaagcactgagaaataccattgtagtaatatatcttcaacttataagttgagctaattgaacattaacttagatagatcatttttatggggggattcctaaacctaaaacattgtattaaaaattttgtcaggttaaaagatcattaaaaggccaatgtttgattaaaatctggagtcttttactttgggctgcaatcagccaatgagtgcatggagttggctgccctcccagaccctgactggctccacgtcgaggtagagcagcgctcccgacaggcagctggaggaactgacgaggggaagctgtttgcatcagggcctcaaaaatttggctcaggattttcccacgtcccctccccaagcccaagctggtcccaggacactcagaagagctcatcattatgggtctaaaacttctctgatctcgctcttctttcttccttccccagagaccttggaattgtcagtccctctcacaggcccttcctttccttgtcaagtgcactccctgaattatctgctcctgggtcagcaattctctagaacttcagggaaagcagtgctgggtcacccacatggggccccagaaagctggctaaggaccagacacacaggcagcaggctaggtccccacagggctgcatggttggcatcgggtagaggggagggaccaggaaccactcgctgagtgtccgtagggccaggtgaactagggaagggctggaacctggtcaaagaattgtgtactaagcaccactttctctgttctatatgctacaactcaactttctctctctctctcttctctaattaacaatgatatcctgtctggtccaaggtcacacatttccagtgttgcaggaatgtctgttgaatctgctaatttgttgctgggaagaatactcaaatttctcatgctcatatttgattgtcaactgtctccagccagcatttctaaaccaggatcctttgacaagacttgtgaagaattttgtaaaaagtagcccccaggatgtcagtgttcactgttggcagcaggactgtttccacgcagtagggctactgcaagccacacctgtccccacacagtagcatcttcctggaggtcaagagtgattttgtttgctatgctgccccagatcacctaatttattacctgtgaatttcacacactacacatcctgcctgtccccaaattcttcacttatgggcaaatgtcacatctgacctgaactggtttacatcccagatccccttcaggcttcccactgtcctttcagatcctcacacacccaagacccttctccgcagggcacagacacagctccctgcacacgcttccatcacttgtctcttcactccttcctcaaaggaactccacagactcttcttcagggaggccttctccaatcactgaagctacagcagccagccagtcagcttctgtcagaactttcaatgattagctgcatagagcttacaattacacatttgttttttctatcgttatcttttgactgatttatttctattaatcattgcattatcagtcagaaatgctttttcactacaagaacacatgtggcaggaaccagggagcttccaattttcttccacaaaaataagtctgcacgtgcttggtggttgttttccagatgctctccagttccataggaagctcaaatatttctacctctccattccctttcaatgagatgttgactttgttttcattgttgttgatgtaagacctcagcatggctgctgcagctccagctatcacacccaagttcaagagaaaaagcaaagcacaaacccaatctagtccttccttcataagaggaaaagtttcctgagaagaatctcagccatctgactcttacatcctatggaccaacgctgggctacatggtcactgctggctagaagaaactggaaatttgcctgactttcaagtgaatagaggggatgacacacaagtagaaggtggtagggagtatctgctgggtctgtaaacccaatctgcctactgcactgatccagcaacaggacaggaaactcctcagagcaaggactgtgtcttcctcatgctgaattcctaaaatgcattcttgccaggacagagtgggtcagggtgaatatttgttgggtgaatgagcttctgtctctgttgtattgcaggagtcaccaccagtgcacattggccctgtatttgtatccagaaccaatcaaagccacccctgagtcctgcatctctcagtaccaagctccagtcccccttcaagaccacccaccacacagacgtgcagggagcctcaggagggcactgtcacctccttctccacatgtgagtgtttgtatttccatcaggaatctgagcacctcgtgcccaggtttgaggcaggaaggggccacaaacagaagagaaatttcttctctgaagtcaacagtccatgaatcaaggaatcagggacctgagcagcagattctgaagctacacctgaacccaggaggcccctgagcctccagctgacagtgtagagtggccacctgggggcagcagagagtaacctggcaaaaatccctggaaagggggtggagctgggcatcagggagatgctgacatgcagggagggtcagtgaccatgacctgagacctggagggaaagaggttcctcttttcttagaatatttgtcattgacactgatgtttaaattcttctgacctcctgtctctcagatttgactcttggaaatggtgcttatttttctgatacagattcagacaatttgcctcttctcattgccctggcccccatctcactgtcacacatgccattccattctgtagtcacgcgtgtcccacctccctgcccttttctctggtagctcgtcctgcagacacaggggcttctccttccctggccactcctccacgtccactgtccccagtctttcccaacactgtcctggggaacctgccaaatcacagctcttgatttccttatgaggcacaaaatacttgctccttaatcttttgttgacttaagtttttatccattgatatattttcccagcaagtgaagacaacttagttataataaacattcacctccagggtcttggagtttgcagccccctctcattctctcacaaagccaacatttccttcacctcctgatgtgtccctggccctgacagcaccctggggatactgaggcacagcacctatgacctggcattagaactcacagccaagtagaaacttatcacatcccatggatcttccaaaactctgtgtgcacttggcaaccaagaattgcattctcctctagcactgaggggctgtgccctggggtggggcctgtactggtgcaaggcttgtgctgtcccctgtagagtgggaagtaaaaggtccctgcattgggttctggattgtgtcttcaaaatgaatttaggcctataccaaacatctcatgtctgacataaaatatttatgaccaggacatttctagagaagcagaagaaagttaaccacctccctcctgagccaggatggaatggaggaggggactgtggaccccagataattcccccatcaccactgtgactctggtaacctcttgaacagggccaaccactatcccataggaaggactttatatcccctagaaaatacagagaaactcagctctgagtttttccatgaccaactcagcccaggggcaaaagtgggcacaatctgggtaaagatgtgaactcagaccatgggaccagtgggtggaggagaatcccatgggctgagggggtgggcaagcagtggtcaccccttttctctctctctctgtgtcccttgggactgagcccttctctggaaaccacaaagctcctccagcagcaacccctgactctgctggtttgcatcatgggctgttctctccagcaaggggataagagaggtctgggaggaacctgcctagcctgggcctcaggaagcagcatcagcagtgcctcagccatggcctggacccctctcctcctcagcctcctcgctcactgcacaggtgctctgcccagggtatcaccaacctgcccatccccagggctctgggtccagtgtggccatgactatgagctcaggagggccctgcctgtggtgggcaggatgctcatgaccctgctgcagggtgagggactggcggagctgaagtcccctcaaactctgctcagaggcttgtgagagcctgaggggctgcacctgccaggagagagtactgggttttcagttcaaaggctccatgcagagggaaagtccatgggccactggggctagggctgattgcaggggataccctgagggttcacagactctctgaagcttttccaggacagcagggcaggggatttcatacggatcttttacctaaaagccatcctctcctttttttttttttttaatctttgcaggctctgcgacctcctatgagctgactcagccacactcagtgtcagtggccacagcacagatggccaggatcacctgtgggggaaacaacattggaagtaaagctgtgcactggtaccagcaaaagccaggccaggaccctgtgctggtcatctatagcgatagcaaccggccctcagggatccctgagcgattctctggctccaacccagggaacaccgccaccctaaccatcagcaggatcgaggctggggatgaggctgactattactgtcaggtgtgggacagtagtagtgatcatcccacggtgacacaggcagatggggaagtgagacaaaaacaccctcccagcctcggtcaccctcttgctccagccccgggaggcctatggatagagccatgagtgaatctggtccagttcacctggatctgagcctcccaggccgcccttccctccagccccctccaggagtctctatagagcatacatcaggcatacacatggcctggaaggaccagaatcatctaatgacttggggctgtcgtgtgagttagagaatgagggcctgggtggaaagacagacagaagcaacctctgtcctctgtcttacccctggatggtaatggggtggggatgaggccagtccttagaccagctatctggctcagtccccagaaccaaccctgctgaggtcctggcccccaggctgtgtggcagtctgtgattcccaacagaccaaaccagaggaggggacactgtgaagtctgcccaggtcccctcttcaatgtgacccacctagcactgctgagaagcccagcagctcagagctgtgcccacaatgggaagcgctgttggttgcagaaagcttcctcaagtttatgtcctttctcagatggttttggtttaatcaaccaagatctcaagtccctgccttaatgtaagatgccactgaatgaagggcctcccagctccagagctccctgtgtggacggacacctgaggcctcagtggcaaccccattatgagtcagggtctccttctgcccactgttgcctccctcactctcttccaaatcttctgtgcatggaaatcattgcagtcaccttccagggaaccccatctaagatggccagctgtccccaacatgggctgtcagcgacccgaggagtccactatccactgaaaattctggtttctgtcctaaattttcagagtacatgttcaaatggccaatctgatggttccttgaatttttatggaatgaaaagggagcctgacatgctctaggttgagagatagttggagtcagatctccctgcagggaaacctggggcaggcagagcatcctcgccccacgcagggaccacagatgcacccacagggtgagctgcaggatggacactgcccatctccgccttccacatcttctccaaatgtcacccctttctacaaccccaacccaaatcattgatctccagaaaaataacagtaacaatagccatgaaaatctatgtaattcatctcataatttcatgttaacatgtgaaaatgatagtattttgctttattgacataaataaaatatactatttatccaattttatttgtcttatatttttatatttaatgtggtgaccagacactaggggtcacaggaggatcgtgtcatactgttatgggacagagctggtcaggactctttcaggtgacaggtgctgttgagtaacctggtgcaggaagccccatctccaccagacccaggtgtgaacccaggaagaggcgctggaacaatggagaggagaacctgcttctgcggaatacagtgcccttgagccctgcccctgctccatcctacgtgtgccacctccatctcaatgtggatcatttcttgccctgcctgaggtcatgactgaggggatctggcaggtctggctgtgtggccactgctgtctcatgtggttctggttgtaacaaagcccaggaacatagaagaggctgttttcaaaaggtaaataataatctactgcacatgacatagacttgttgctaaatcccatgggtctacagtaggattctcctgttgaggtttgccttaagcagaaggtttcagttcctttgtccagttcctctattatgatagggtctgcagtttctctggcccaatagcaggacactcacacccccgcctgcacctgctgcagagcctttctgctcttggccccaaaacaacgggtgacacagttctcagacccatgatttatggtgtcagtattcaggcctcgggggtccctgacggcttctctggctccaagtctggaaacacagcctccatgaccatctctgggttccaggctgaggatgaggctgattattactgcagctcacataggagaggtggcactttccacagtggtccaggttcatggggaattgagacccaaacctgccctgggctctcagcctctctcttgttctgaagatgcttcctcaccctgtgcaagtggcttcttgcagcaccaccttgagaatttcccctctcccagctcctctcctttctcaccaggaagtccaaaaggaaacctgctctgtgatttctcatccaggacagtgacagcttcctgttgcttgtgtgttgtggtccatgaatgtgcaactcttcctagctcttcaaatgcaggcacatagtgagaaaagctgcctgactcatgaagtcattgctgtttttaggggcgccctcaccctaaatgcatcctcatctcccacgctgtgcaggccaatctgcacagaagtcattacagggagtttcaagaaattgcaccttagtcaactctgtgtccactatgctctcgtgaagatggccctcctggctgggctattcctctgtacctctgtcctgaagcagtgaccactgtgagagctgagcatgtttttgagggattaagaaccagaggaagctgttgtttttcattattattattattattattattattattattttgagacagagtctcgctctgtcaccaggctggagtgcagtggcacaatcttggctcaccgtaacttcagcttcccaggttcaagcaattctccctgccttagactcctcagtagctgggattacaggtgcccaccaccatgcctggctaatttttgtatatttggtagaaacggggtttcgtcatgttggccaggctggtcttgaacttctgacctcaggtgatccacccgccttggcctccgaagtggtgggaatacacacgtgcgccaccacacctggctgcgtttttcttatttttgttcctcttctttgcctcaatacctcaggttgctgagctggggagattttgagtgacagactcagtattctctcaaaatccccctctctcacatcgctgaggccctgtcctggaaactctccaaaagtggatggtctccctataggatgggagcttccaaaatggctccacagggaagagttaacctgagttcattccttcctcctcattgacatccagcatttgtaatttccatggccatcaatactactatagctgaaatcttcattaatctactaaaggtgagagtgaatttcatacatattcaaacattagtttcatccaacatttaaattttatgagtcaattggtaaacatagccatgattacatgtagtttaggcttcataaactttgattaaatggattttatttaaaacaatgtaatcattttactatatgtgtatcctacctatatcaacatgttgttacttgaaatatccacaagaaactatatttcaaaaaccaaattgtatttattgtctattgttacataaaaattgctccctaatagttagcatattaagagaacacgtgtttgtgatcttgtcactttggtgcatctggaattgagagcagcttagttttgtggttctggccctgggttggtcatgaagtcgcagccaagctgtcaggccaggctgcattcagaggccagagcaggtggccaggcccagcctgaggggcttccactgtccctaacctgtttggctgattggaaaactcagcggaaaaggagagagtgaagtgtaaggtgcctgtcctggtcccccatgtcaaagaccattccatacatgcaccatttcttattctttcctgcaacatcctaggcatagagcactgcccattcattctaaggctgtagagtattccacagtagaattttagccatgcaacctctaatggttaacaccatgattttgatcttacaaataacactgcagcaagcatccttatgccgactcctttgagttattgtgtgcatatgatcataggataaattttcagaagtggaattactgggtcaaaatgatgtgcatttgtaatgtttacccattgttttcacatgtttcaccagtttacaatgccagccctaaatattgattggaattcattggtgaaagtgcaaatttttgccaacctatcagatataaaaaagttaccttgttacacttttatttttgatttctcctattgtgcttgaagttgagcatttgctcaaatgtttcagtgctcattactttttaaaattcggtaaactttttcttaaatgtataaataagaagtattttagtctttgccacacaggagtcaactttggggatactatgtaggtactgacagcaccatctgcaatgtaaacattaaaatatataaaaaccattttaacccattaaccatccccagataatagctgatttcttattagaagtaatgcaagccagagtcagtggagttatatttagaaaatattaaatgaaaaaacttactacccaaagcaatctacaaactcaatgcaattcctttcaaaataccaatgacattattcacagaaatttaaaaaaacctctaaaattggtataaaaccaagaaagatcctgaatagccaaagcaatactgagcaaaatgaacacagctaaagatgtcacactactagaattaaaatatactacaaactatagtaaccaaaacaggaaggtaggtattggcaatcagacactgagaccaatataacagaatagacaacccagaaataaacccatctatcatatagagccaatcgattttcaacaaagatgccaagaacatacactgagaaaatggcacaattttcaataaatggttctgagaaaactggatatccatgtacggaacaatgaaactagacacttatccccctccatataaaaaatcaactaaaaatggattaaagactcaaatataagacccaggctataaaactactagaaaggaacttagagaacattggggaagaacaattctttaggacattgttctagataaaagttgtatggccaagaggcaacaacaaataatagagatatgggacatcattaaactgaaaagctcctgaaaagcaaaggaaacaatcaacagagtaaagacaatgtgtagaatgagagaaaatatttgcaaactactcacctgacaaggacctaatattcagtataagaaaagttaaaaactgaaataactcatcaacaacaacaaaaaaaactaataataccattaaatagtgggccaagaatttgaatagacttttctcaatagaagacatacaaacggccaacaggcatatgagaaaaatgttcaacatcactaatcagcgagggaattaaaatcaaaaccccagtgagatacaatctcaccctagctggaatggctatgatcaaaaagacaaaaaatacaaatgctgatgaagatatgcgacttcatatttttctagtccaattctctgggaacaatgagagtgctctctttgctctccctttagtaactatttttcacatgcaaaaatatgggccctactgggaaataatgcctaagaccaccaacaccttaactgtttgttcatcacactagaaatgaaactgttttccaaataatattaacatctatctgtgtctatcaccattgtgtcaatgtttgtgtgatcctataaagtttagaaggcctagaagaatgcccttgctttttgcaatacaaaaatggcctaacagatatagatgacatagatatagatatagatatagatgatatagatatagatatagatgatatagatatagatatagatagatagggggttgtatcttggaatttgtttctctaagggacttatttcacatctaatttgaaattattctggttttaaacattatagaatgataacacaattggtgaaccaatcattctgtgttgaggttaacagtatttttttacttcaattctcactgaatgagagcagtttttatacggaggggccatgccataacaatatcacatactggggttgttctcagactgtgaggttctgcctacaccaagccaggatgagaattttatttgtcaaactgctctctccacttgtttgtatcccataatataccccaaaaatgagcataatttcattttttatgctgtttgttcttacatttaatacatgtaccaaaaagttgtctttgtttttaaaataaaattttatgctatcttttaatctatgtccctatagaaaaatcatgatccatacacatttgttatcacagaaagaacaagataaatttcctctctctctcataaatgccatgaccgctgctttttgggattatttttcttaaattattttttaaacagaaattcatataacttaccttaatcaaatttcttttcaaagtaatcacatttcttttatgtgaaaaattatttaccttcttttatcaaaaattatcttaatacaaaatatgtattgttttacttttagaagaaatggaaactatctacacattactaatctaaaaatacatgctctgggtttatatggtgttaacatgtcttccaaattttaaggaataggtatttaaatgtcatgcactttgtttttaaatttagaaaatgtttcaaccttttgcctgggcatggtggctcatgcctagaatccctgcactttgggaggccaaggtgggaagatcacctgagctcaagaccagcctgtgcaatatggcgaaaccccatctctacaaaaaatttcaaaaattggccaggcatggtggcaccacccacaatcccagctactcgagaggctaagatgggaggattgctggagccggagaagttgaggctacagaaggtaaactgttgaggctaaaacatggtaaatatttaattgttcacttaaaagaaatgttggttacattgaaaagaaatttggttaacgtaagttagataaatatctgcttaaaaaataatttaagcgagctgttagcactactgcattccagcctggtcaacagagcaaaatctgttgaaagaaagaaaaagaaggagagaagggaagggaagagggaagggaaaggggaaggggaagaggaagacagaggtggagggggaggggtggaggaggaagagggaaggggagagagagagagaaagagacaaagagagaaagaaagacaaagaaagaaggaaagaaagaaagaaagaaagaaagaaagaaagaaagaaagaaagaaagaagaaagagaaagaaaaagaaagaaggaaggaaggaaaaaaagaaggagaaaagaaagggacagaaaaaggaaggaacgacggggaaagaaagaaaaaaagaaaaaatatttcaagcttttcagtagcagagacacttcgtaatcaataagcaacagaaccaaaacaaaaaaaaaaatctacagaacagtctaaatacaattataaacttctgattcggatatcaaaaccatttcaataataaatatatggtatgaaaacctcacaaaggtcaagtagaatgtattatatttgaaagaaattacgagttgagagtaggaaatttataaatttaatcaaacaaataagcattatgaggaagttgtattgctaatgtattatttggcaagctgttcagtggaacaccaagatattcttaaggaagttgcaaatatctttttttttttttttttttttttgagacggagtctcgctctgtcgccccggctggagcccaccaccacgcccagctaattttttgtatttttagtagaaacagggtttcaccgtgttggccaggatggtctcgatctcctgacctcgtgatccacccgcctcggcctcccaaagtgctgggattacaggcgtgagccaccgtgcccggctgcaaatatcttttaagatgttgtcattgaagtggatttaaaagtgaggacatgaatacctttaaaaaatattcagggataaagagagaaaattaaatttagattgtatacatatataaaatgtattttaaaagatcagcttggctgggcgcggtggctcacgcctgtaatcccagcactttgggaggccgaggggggcgcggatcatgaggtcaggagatcgagaccatcctggccaacatggtgaaaccccgtctccactaaaaatacaaaaattagctgggcatggtggcgggcacctgtaatcccagctactggggagggtgaagcaggagaatcgcttgaacccaggaggcggaggctgcagtgagccgagatcgcaccactgcactccagcctggcaatagagtgagactctatcaaaaaataaaaaataaaaaaataagcttgtctctttttattccttaaataaaaggagcagacacttaaattccttgccttttattttaaaatttagaaaatgcttacagcttcccacagtgaaatttatacttagataatctaatcaatggataataatatcaaaacagaattctttgaccaatctattttcttcatttttaagtctaaatgtatactcaaagaaataaaactatttataattgattctgctgtttgaaaatatttactgatcatttaccttgcaccaactgacctccagctctgaagataggtcagtggtaaagtatacaaagttgcccagcttcgttaaacttaaattctaatgaggaaaaaagaagtaattaatcagggactttaaaacaggagtgttgtgatatggcttggaattctaattgcttcctgtgcttgctgtgtggagactggattgaaaaatagggcgatgataggagcttaaattcatacagaatatggctagcctgtattttgagggcccctgaaataagaatgtatagtagttctcattatttcctcaagaaatctctgcagtagagctttggccttgggagggaagtactatagtcaccaagtggtgagggtgggaaggtgaatttgcaaataccatttggaatgagttcactttaaaggtaaagctggcaggattttcatacatgtcagatctgaaaatctgtgtgtgcgtgtgtgtgtgtgtgatagagagagagaaagagagagaattagaacaagacagatacagacagacaatgacagagctgcagagacagagagaattaaatggggacaccaagaatattgagctgagaaactataaaatgggaggtgccattaaacagaatggggaagagcagttttggggagtgtcagtggctccacgtagacttattaattttgagattcctaaaccacatccaagtggagaagacagacagtattgtgtgtagtctagtgttatggtatcatataaaatatcaggaaatgaatgacacaaaaattagtaagaaagcaaagataagaaagataaaagtcccgagcctagtggttatctactgcctaaaaagtagtaggctgggcatggtggctcaggcctgtaattccagcactttgggaggccaagttgggcagatcacctggggttgggagttcaaggccagcctgaccaacatggagacacctcgtctctactaaaaatacaaaattagccaggcatggtggcgcatgcctgtaatactcaggaggctgaggcaagagaattgcttgaacccaggaggtggaggttgcagtgagtcgagatcgaatcattgctctccagcctgggcaaccagagcaaaacttggtctcaaacaaaaaaaaaaaagaaaagaaaagaaaagaaaagaaaaagaaaattagcaaagatgagaagaaaccagcaaaaagtactaggtataattatcaaaaatgtcaagaggaaagtaggttaagtgttctagaattctatcaaagaaagttttgaaaaaaaagagggagagatcaactgcattaaatgctgctaatacataaattaagcaaaggctgaggaattacgcttcaattcatcatttaacaatatggataccatttgtgctttgataagagcaattttcttggaatgagtaggtgagaaaccatattggagtggtttctcaaaggaatgcctgatctctgggttcttaaggaaactttttattgaacaggggaggcacaaattggattagttttaattccggggtccggacacactctaaacatgtgcctctgcatgcctcgctttttaaagctaggtatcctattatctttcgataacaaaataatcacctgcaaaaccaacacacatttaatggacacacttgtaaagtgtgtactagaggttgttggagaggatgtgattccacgtgatagcttacgagtcactgatgggcaggtaagctggtaaaatatctttggaaaactcaccatacctgttatacttaaatattcagataccaaacagcagaaaatccatattgtaatatatttccatgagaaaaaacaagagctctgtattaaaatattgattattattaaaaataatcccactgggtttcctgacttttttattagcaagtcagtctccgcctgttttcagtagtacaacctctatttaacaaatgttttgtatttttaatcagccacttagaaaaaatattatattttatatcaattctacgttcagtgccaaaaccagtgttttgtacattccacagaattatttgttgaataaataatgaataacttaaataagttatagtatccatatataaataatatatcatctccgaatacagtgataacatttgttatgtagaaaatgatttcaatctcagttaaaaatattttgggcataggagttactgtcatataaagattctcacattgttttgtttatatgaaaatgtttgcagttaacgtacatttttggtacctaaggcttttgctcttgctgccatagcaaacagtgtgcctattaagaacacgaacctgagttttatttcattttaacagatttcttaataaaatatatgccaccttatttggtttaatacataagcaaagagccatccactccaccattgccccttgtccctcctccaatgcagctccttaagatgttactgatagcagaggactttgtgttcaacctaagcactttatagcccttttattttcaactaggtatgaggtaaaataattcagcaccaataaaacaaacactctttaaacaatgaccctttttcttagcctgttcaacaaaacgcagcaagacagagtacacttctctttcccagcaaatcagtgttgccactacattctctacgttctgaaaacttgtattattgactttcttacaaacaccctttgagcttataatttagatgtcatcaaataatgtacaaaaacacgctacttcctcccccttctcttctcttcttaccagactattgtcagtttgcttttctatccaactcctttcttctgtctacttgatttttaaaagactttctacatatttactatcttggtattgtagagaccaactatgtggtcaaactacacatataggaagaactgaattatatgcaagcatttttaaataaacgattcctcctcagttttctgtgattatttcatataatcaaatgtcttccagatacacatcccaaacgagtggttgtcaagctctgctttgttgtctaattttatcagaattatccaaaattcttatgataaatacagatgaattagcataactccagatttatgaaatgaaaatttccagaacccaggaatatgcattgaaaaaatgtattcctcacgtggtgctgatgtgatatgggatctgagtttagaatccaaggaaaattaccctccttgccctctagttggccagaattacctagttgaccagagttgctctcttgttatctagaggtcctcttcccttttcacattctgctctctctccttctgtaccttcctcctctcctccctccacttctgctcatccagatcccaagcccttctccattgattctcctaaaactccaaatggtcagttgccactaaagtccctctgtcccatgaacaagatttgtgggcaaatgtagaatttaagcttggacagagctgaatcagagctgcaattaaagatttccctaaacccagcagggaccagcaaatacttatagaagattagagatttcttgtgagtgcaaagggctcagagtgacctgatgctatagaccaaatcttatggtcccctcaaattcatgtgttaaaatctaattccccatatgatgggatttggaggtgaggccttggaaggtgattagatcatgaaagcagagactgtatgaatgggatcagtgtccctatcaaagggactgctgagagctccctcatctcttctgtcatgtgaggacacagtaaaaagatggcagtctatgaacaaggaaggaagccctcatcagacacgaaacctgctgacgagttgaccttggattttaccatctccagaagcatgagaaatgaatttgtttctctgctacctagtgcagtgcattatcttttggcacccagattggctacagtaccaacatatcaacttgtacacgtaatttttgaaattctgatgccaaatctttgatggcaacaggtgattgatctgctggaggaatggactgacatgatccctctttccacaataaaccagagagtaaaaacaagcaaaagtaggtcaaggtcttctaaaagccgtacctgaaaggtttccagtaacagttgattagatggtaattcaatcacacaaacaaccacggcaaagatacacaactatcagacattttcagaatagcctctaaaacaacatctgacaacattagggagttaaagaaggcacgaactttcaaaaagtcaaactttatttaaatgttattgtagaaacttgtaattttaacactatggatgaattctagggcaggtggtggcatggcatggcgatttgggggcacaagtgctgagttttgaagcttcggttttgataccctttggagatgccccctggcctccacacccctgcccacctgtcaagaagagcctgtcctgggcagcacctcagggacaaacagcccagaagcccagttgagggcagacctccaaggttggaggaagaagccgcctctgggagcaggaggagctgctggatcccctcctcccaggtttcttttcctgccccccagcgcctcttgcaggcaggcaaacaaccccagcaggagcagcagcaggcccttcagccgcagggctgcagctctgctgaatgagagaagcctctctctggcgagtcagaggagcgcaggccatatacccgggtctctacctccatgtctcccactgtgcccaggactgagcccagcgtgggagatgcgggctggggccgtgctggccaccccctctcttccacctcttgctccagccatgctttcagctccagggctgaggccagtggctagagcagatctcatgatgtcaggtagctcctcactgggctggtccttggcaggaccaggacaggggcaggagggatctggagctgctgatagctccagttctgtccctgaaggggggtcttcccctggtgctggcactggctcatcagctggcgctggaatttcctgtgttgctgcacatggaacaggagatgaaaaagaagaaagactcaccaacgtcagtcactttccactggaattttcacacacagaatcaacctcgctgaatgtaaggtattccagcccgaaaacactgcccctgcaaaggctcatagactataggccacctcaccgtgtgcctgtgcctcgatgaactccagaggctccagctggacaagaacaatgtgcagatgtggccgcgatgggatcaccggtggggcctggcctggtagggcctgccctgggctgccctgtggtacttgggggcgcctttgcccaaatggccagaggcgcctggagtgagagatgagtgaggtattgcccctcacaagagggcattagctgcggggatccgcccacagaccctgacccaaatgacggatgaataaaacgtacactgacacagagttattctgctttgccagtcctgctgagtgtcccactgcctgcacaccaagagaggtttgtcactgcagctggccgtgaatagctcgcactgcaggcatttatttagtatagaatttacaacggaagctttgagtaaatactcttgtggataattaacatggttaagagagtagttctaccaatgattaaagctcaggtaccatggtttaaagtaaataccactgggggcaatttcccgggtctacctcccccctcctccccaagaggactatctggctcaaaggctagttaatggaagtagggtaaacagacttaactggggaagcctctattgtccctaacatttaccctatgagctaatgctctaagataagaagcagctgccttcagcctgttcaattattacaagctatgtaacctttccgccttccaaaaggtttgtgactattccctgtaactttccctaatatttccctttaatatttctgccaccatcctgagtgaatcccaatagatgagcctgcgtcagcattgtgggaaaaggctctcgctctgggccctcctgaagcaggagactcgagatgtgggaatgcagcatgagaacatcttgctctcctgagcatctcccaccaagggagctggctgcgggtctgtccctaggatgtgggtgcctgattaccagagttctaagttctgttagagtccatcaccaaggaagtgaagtcacttctttaaggttccgtaccctcggctccttccttcaaaacctactcagaaccccctgggctgctggctgctcaccctccccccaggtcagctccttacctgtacacaggtaagtccacccagtgtctgcttgtacacctgtgcctgatgtgcacctggggcctgggaatccacttagggcctgtgatccaacaggggcctaatgttgattaaaactaattttgattattcctatggagaaggaaaggccttctagcaataagaagcagagttccaaatcaaatacgtaaaaatgatcaaaaccttgtaaaagaaaagtatcttaattttaatcactgaaatgttaactttttgataaatatttaaggttataatgaaaaataaaacaatactaataaaataacagttgcaggaaatgctattgagtttcttgtttgtggtttgaacactgaaaggtcccacctagttatggtcataatttcctaccttaatcttcttgttcttatgagtaatagaaaaaaacacaatgacgatgaatgtgatgatggttcaaatacacaactgaagtttagtggcagaaacatcaggtgctcccaattacagtgcagctgttcttactgaggtgagaaaaaaaatcttgttttcaatacacacgggaagcaggagtgcacgcggatatgaccgcatttctctgaacttatgtttttcacagaagagctacagtttatcctgcattctccgttctgtgatcaaaaaccatggaacagagaagagcatttcaacctgagactcaattataagaattgcgtctgccccacctccctgcaaccatatatgccacctctctgtgctgagcctgaggggttcacatatggcacagactgaggctggactcaacagtccttaccctcgcaggtgacaggcgttctggggtcacttggaggagggaagctcctgggctctgtcttctccaccagcagggggcagcacagctgcagacagaagagaggctgaggctgcccagaaggagcctaagagggaggccagccatgaaggctcaaaaggtgtccaaggatcagtcctcaatttggaagtccagtaaagtgcatcctatcccctcgggctgcagtaactccgtcctgactgtaagactcatgcagcgtcactcagggcactgacaggagcccagggacagtgagagcctcacctgggaaatgtagctggaggcgcctgggccccggtgtcagcctggggagcttccacagggctgggattccctgggagacgccccgaggtcaaggtgctctaggagggggccacagtgtgagaggacagggtttccagggcccaagcccttcacctagtattgctgcctgagcctcctgccactctcatggtcttgtccctctctgatcagcagcattctggggagctgagccctcagtcctgggcacttccagagacctccccccgccaccccttctccctctgcctttccttccagctccaggcatactgtgactcagggggcagctcctgtgctcaggggagtctcacgtgggtggggtggtgcactcaggaccctggctccaggatgtggcatttccagcctccttgaggagatgctctccacagggaaggggattctcacctgcctcaggccagagctctggccacgaggctgtccttggctcagggacaggatacacctcattgcaggaaccaaggaccacccaccctgcagaccccacaccctgtccaaaggctgtgtccctgggatgcttacagcgaccatggggcttaaagttgaatttcccatcaatatttcatgtaaacttgcaaaaagcacaagaaaaccacactgggctgagaactctggtgctattttgctgttttttacaagtttacataaaatattgattggaaaaataaacaatggcagagctgaggatggcaatggctggtctactgtggggatggggatggcctagaagtatcagccccatgggtgaaatgagaccagacgtcctgatgactccacatgggtgagtggttccttaaatgactcaactattctcactgaaatagttaactagtgtcctaatgacacaatccatcatttagatgaaatgaccaggatgggacatttcctccagccaggaagactgtggacaaattcatgaactgggctggcccagttcacctgggtctgagaccccctggatctgagtccctccagccctccaggcaggctctgaagagggggcgtcaagagtggatttagacttaggtgaccaggatgtattggggtttgaggactcagctgtgacttagggaaatggggcctgattgaatcatcagactgaggtagacatccatcagctgggctctggatttccattggtcatgacaagccagtccttggcctgaatatcctggatcagtccccagaactgcccagctcaggctcaagtcattctctacagaaaaaccagtggagtggacactgtaggatctgcccagattctttcttctgagctcacccacccagcactgctgggagcttgtggcagctgagagctgtgcctttcctgggaagtgtggctcagcgcagaaaactgcctcctccaggtttatgcccttcctcagcaagattaggtttcatgactgcctgaggccaagttctcaagactctgcctcaatataggaggaaatgaaaatcctcccagctccacagctccctgtaggaaagactgagacctcaatgtgcgtcagggtctctttccgcccagtgttgcctccctcacatcctctgtgcatgaattcctcatctcagagtctgcttccagggaacccaaattaagatcaccagccatccccaacatgggccatgcggaacctcaggaggccactgcacactggaaagcgcccatttattcctaaattagcactgtgagtatccaaatgcccaatgagatctgagtgtttcttgcatttgtatggaatggaaagggagcctgacttgccaggtgctctgggtctgagggagagttggagtcagatctccctgcagggaaacccgggacaggaggagaagcctcaccccatgcagggaccacagatgcacccacagggtgagctgcaggatggacactgcccacagggtgagctgcaggatggacactgcccacctccaccctccatgccctgtagaaaaaatcattctttccacccctccttcagcctatcaaagttgacacttaaaaagccaccacaccccacccttgtcaacaggaaacccattcacatctccatcagccacacaatctccaagattcttcaaaaaataataacactagctatgcaaagtatatgatatatatcataaataattgtacctagattatatatgaaaatgatactttttgatatgctaggtaaataaaatatattatttaaactcattgacttcttctctttgtatttataatgcgatgactagacagtgggattcccatgaggctcacatcatattgtgattgaacaaggctggtctgcagggcttcaggttacaggggctgtggagtgacctggtgcaggaaaccccgtctccatccataggacatcagtgtgaacccagggagaggcgctggtatgagagatgagaacacaggtgtgaaccacctgcttgtgcaggggactgagccttcactttgagccaaagaagtttcttttcctatcttcaatcctgaacaagagggctttctggacttctttttgttttcagatttgtgccccttcaggtttggggctgtctggagtcccagccagaggacagtgaggaaatccaggagtctcacactgactctgttatatttcatctgctggggccatcccaaactgctgtgtaccatttcctttcctggtgctcaaatagctgctccattcacctgtcatggtttcagagatgaatctaggtgggaagacaggacagtgtatgttataatatttaaatggaagctgattccattaatatttattttaatatgaaacattaaaagaattttgttataggctatagggaaagatgaaaagagattaaaagtattttgaaaaaatgtatttatcgaatgtctgtgtgtcttcagtgttgcagggttgagagaggtcagctttaggttggatgtgctcagatgaggaaaagcaagaaagcaggaaacacgcggctctgtgacctgacacataaatcacagtaaaatggaaataaatctttcaataaatgaaacattcaaaataaacgtcactctggtgcacacagaaaggcctattagcaaactttccctttgtcctgctggctcatatccccatggatcacctgtgtgcagagtggacactgtagtccccatttctcaggctgagaactagaggctgggaaggacaagtcacctgcttgtgagtgggaggggcaggattgggagcagtggactcgggctcaggactgcggccctggtcggtgctctgtgttccctccacaggatccctcccacatgtgcccgtgtggatgtgggtgcactgcctggggtggctgatgtgctccagggattcgatggtgcagatgcttcagcacaaagcttgggggtggggatgggatgaggctgcagctggggagaccagggaccaatgccacccagcagaggtttccacggggtgggcagccccatttcctggcagtagagacagcctggaggtgggtgccaagcagagggcactgcagggtgtgcccaggcctggagggtcacaaagacacaggcaccacacagcagagtcactgaggaccagaagctcactcaggtaagggatttcagcagaactttctctcctgagcaaatcaggtacaaaaaaattaagatcctgccatcagaaaagacaaacaagaactttttatctcctcagctgagccccactgtccagggaagcagaagtctctgagcccagcccaggtgagggtggggtgaggagaggagctcagggtggagatttgcatggaggccccaccctcctctgaggcagaggggataagacagggctgggggcaggcccagtgctggggtctcaggaggcagcactctcgggacgtctccaccatggcctgggctctgctcctcctcagcctcctcactcagggcacaggtgacacctccagggaaagggtcacaggggtctctgggctgatccttggtctcctgctcctcaggctcacctgggcccagcactgactcactagagtgtgtttctccctctttccaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacactttccacagtggtccaagttcctggggaactgagaccaaaacccaccctgggctctcaggctcccttttgctctgaagatgcttcctcaccctgtgcaaggggcttcctgcagcacggccttgagaattcttctctctcagctcctctcctttcccaccatgaaatccaacaggaaacctgccctgtggtttctcatcccggacagggacagcttcctggtgcttgtgtgctgtggtccctgaatgtgcagctcttcccagctcttcaaatgcagggacagtgacaagcagctgcctgattggtgcagtcactgcttttttttcagagatgtcttcaccctacatgcatcaccatctcccacactgtgggtagaattttagccaaatatggctgggcgcagtggctcacacctgtaatcccagcactttgggaggccaaggctggcagatcatgaggtcaggagatcgagaccatcctggctaatacggtgaaaccccatctctattaaaaatacaaaaaattaaccgggcacggtggcgggcgcctgtagtcccagctacttgggaggctgaggcaggagaatggcatgaacccgggaggcggagcttgcagggagccaagattcgtcactgcactccagcctgggtgacagagcaagactccatctcaaaaaaaaaaaaaaaaaaaagaattttagcaactacattctaatagttatcgccacaactttgatcttaaataacagtgcagtgaacatccctatgcagcctcctttgagttcctgtgtgaatatgaccataggatacatttctaaaactgaaattgcgggtcagaaagatgtgtgtttgtaattttcacccattgttgtcagattcccctccagaggggttctaccaacttacaatgccaaccataagtatttgttcagagtacattgttgaaagtgtaaatttttgccaacctaccagactgaaaaatgttatcttgttacagttttatttttgagtctcccattctgcttaaggttgggccttttcacaaatagttcagtactctttatttttttagtatttggtaaactttttcttgaatatccaaataagaagaattttagtctttgtggcaaggcacagtgggtcatgcctgtaatcccagcagtttggaaggcttagacacgtaaattgcttgagcccaggagttcgagattagcctgggcaacatagtgaaccctcatctctattacattaaagaaaataaacataaattttaaaatgaagtattttagtctttgtggcccacgaatcaactttggggatattacataggtacttacagcaccatttataaagtaaccatttaaaatgataaaaaccactgtcagctctgggccacacaaaaacaggtgtcaggccagttctggcagggtgagggctactatggtgggaaagggaaatggaagccagtagagcttctcctacctagaaaaatagtaaatcaaaaacagtgtcatatccctggagggattgcagagattagtgccaccatcaaggacttgaaagacacagaggtggtgatcagcaccacatccctgttcaactctcccagttggcctgtgcagaagacagatggatcttggagagtgacaatggattatcataagcttaaccaaatggtgacttcaattgcagctgctgtaccagatgtggtttcattgctcaatcaaattaacacatctcctggtagctggtatgcagccattgacttggcaaatgcctttttctccattccggtccattaggcccaccagaagcaatttgccttcaactggcaaagccagcaatatacctttactgtcctacctcagagatttatcaactctccagctttgtgtcataatcttgttttttttttcttttgagacagagtctcgctctgtcaccaggctggagtgcagtggtgcaatctcagctcactgcaacctctgcctcctggattcaagcaattctcctgcctcaacctcctcagtagctggggctacacgcgcgcaccaccacgcccagctaatttttgtaattttagtagagacggggtttcaccatgttggccaggatggtcccaatctcttgacctcgtgatctgaacgcttctgcctcccaaagtgctgggattacagacctgagccaccatgcccagccctttgtgtcataatcttattcaaagagatcttgatcacttttcacttctgcaagatagcacactcgtccattacattgatgacattattggattggattcagtgagcaagaattcacaaacacaatggacttatcggtgagacatttgcatgccagagaatttgaaataaatctgactaaaattcagggaccttctacctcagtaaaatttctacgggccaagtggtgtggggcctgttgagatattccttctaaggtaaaggatacgttcctgcatttggctcctcctacaaccaagaaagaggcgcaacgcctagtgggcctatttggattttggaagcaacacattcctcatttggttgtgttactctggcccatttattgaatgaccctaaaggctgccagttttgagtgggttccagaagaagagaaagctctacaacaggtccaggctgctgtgcaagctgctctgccacttgggccatataacccagcagatccaatggtgcttgaggtgtcagtggcagatagcaatgctgtttggagcctttggcaagctcccataggtgaatcacagtgcggtcctccaggattttggagcaaggccctgccatcctctacagataactactctgcttttgagagacagctgttggcctgttactgggctttggtggtaactgaacattgactatgagtcataaagtcaccatgggacctgaactgcctgtcatgaactgggttctttctgatcaatgtagccataaaatgggtcatgcacagcagcattccatcatcaaatggaagtggtatatacatcatcaggctcgagtaggccctgaaggcacaagaaaattacatgaagaagtggctcaaatgcccatggtctccactcttcccccctgctttctctcccccagcctgcaccgatggcctcatggggagttccctatgatcagctgacagaggaagagaagactagggcctggatcacagatggttctgcaagatatgcaggcaccacctgaaagtggacagctgtagcactaaagcccctttctagaacatccctgaagaacagcggggaagggaaatcttctccgtggacagaactttgagccgtgccactgggtgtgcactttgcatggaaggattttagccaactacattctaaaggttattgccacaactttgatcttaaataacagtgcagcgaacatccctgcatccctgcatggaaggaatgccatttcccataaatcaccaaatcactcagaatgactacgcataagcccttaatatacgccagatgcattggttattgttttacaagcgggacctcaagaagactttcataatacggaataggatgatgcaaagccctatgctcaaggcccgatctttactagaaaactagtattgggaggttacatgttttccccaaacagatctttgaggaatcccgcagatgccaaagacctgctggcctaagagtagacacttattttctcacagttctgaagctggagagccaagataaaggtgtttataggtttggtttcccctgaggcctctctccttggcttgcaggttgctgcctccttgctgtgtcctcacatggtctttcctctgcacactcatttctggtgtctcacttctgcgaatgcaaatttttattagcctgggttaataatttttatatcagcctggcagattctatcactgatttacttgattatcctatttacttgattattaaactccttctctgctgaggtcacccattggtgagcactcgcatgggatacaaatatcttcacagtttttgatcactcagagggatccatccacatagctcttccccaaatttctttgtcatcaattttccaatcatgcttcttccaagtccctgatcatccaaccaaaccattggctacagcctatgaatcagtataaaattgcatatctggacatttctccttccaggcagtgctgagaaaagtggacatccacatgcagaacaatgaaactggacccatctctctccaaataaaaaatcagcccaacaaggattacaaacctaaggataagacctgaagctataaaacaactagaagggaacatagataaaattcttcaggaccttgggatacacaaaaatttttatgactaagacttcaaaagaacagacaacaaaaataaaaatagacaaatgggagtttattcaactaaaatgcttctgcaaagcaaacaacagattgaagacacccttagaatgggagaaagtattcatgtgaataggtcctaatatcctgttcatctgaaaaggcataatatccagtgtaagaatagaggacaaggctctaaaataactgattagcattaaaaaaaaaaaaagtgggcaaaggacctgaatagacttttctctaaagaagacatacaaatggcaaacaggtatgtgaaaaaatgcttaaggtgactaataatcagggaaatgctaactaaaacccaaatgagatatcatctcaccgctgctggaatgactatcatcaaaacataacaaggctaggcgcggtggctcacgcctgtaatcccagcagtttgggaggccgaggcgggcggatcaagtggtcaggagatcgagaccatcctggctaacatggtgaaaccccatctctactaaaaatacaaaaaattagctgggcatggtggtgggcacctgtagtcccagctacttgggaggctgaggcagaagaatggcatgaacccgggaggtggagcttgcagtgagccaagatcgcaccactgcactccagcctgggcgacagagcgagactccgtctcaagaaaaaacctaacaaacacccgtgacgatgaagagaaaatagaagaaaaaatcacatgactgtctcaacagtcagatcaaatgttttctttcaaggaaacatttttgttggttgttttttctagtcttgttagagcatcacgcatgataagatttgtggtacagaagttagaggggatgttgttccatgcaaaatatctgaatatcccatacccaactcttcggttacttactgataaatgctaaaaggttacaattttgtattttcaaatattctggtggccagaaacctcttccttgacaagtctggagtacaggtatctgactccagatgattagaatttaggcaggtattgtgtgagcagtgaggtcacacacaggaaacgttccagtcaaagagaaaaacagacggaggctgaaacacagagatcatatgtctgagaaataaggaaattccatactaatgggagctgagtgagaacaagatatgaaccatctatttctctctgaatatctcattgggatcttgtccctttcccagcataccactcatgtggattttaaaattgtctgctcttaaaacatttcttgcacatcattagagagtccagcactggaatcaagctcagtttgatgagaccagggcagttaagcaccaaacccaggtgttcttagaagggcttgtagaagacaaaggtgtgttgtcaaaagcagagaaagtgagactttccattgtggtttaaaccacagcttctggaatttcattgggcacacaaatcccctgaggattctggttaagatacagctgtgccctcagcacatctgggtatggccccagattctccatgtctagcagcttccaggtgaggctgatgctgctggtcctccaaggacattttgagtggcttagctcctattcaccctcctcacgcaggcacaggtaagactcacctaatgaagaaacctgagaagcacaggtgaactctccctcccctcctggtgtcttagtaccttttgtgttgctataaaggaatacctgaagctggatagtttgtaaagaaaaaaaagggtttattggggtcatgcttctgatggctggaaagatcaagattgggtatctgcgtctagtgagggcctcaggctgtctccactcatgatagaaggtgaagggaagccggtctgtgcagagatcactgggagagagaaagcaagctttttttcctaacaaagctgcagggatgtaattgagtcatattcataaagtgctcaatacagggcgtaacatattcaagtgctccttagtggacagcaattattactgaccttgctcatgaaaattagacctcagatggaggaaaggcagtgccgagggttttagattgttcgaaataagagagattaaaatgatttaaaatagaggcccaggagctgaggcaagcatccccaggtgttctcctgccaactccccccatgtctcagaagctgttttcaggcaagtcagccagggaggaaagtgggggagtttgtagaaccaaggattgcaacttcatccatgaggaggaggtgtagccagccaggtggggagaggctgctaagctcatctgaaggctgttgaaggctttctggccccatggtcctgggccatccctccctgcccagggccgcattcctcagctgacagccacaaccttgagagaggcctgtgagtctgatcagaaatcctgccagggccccgagggggcaggcatggaagggaggtgtctaaggtcacaggagacactatttgctgcctgtggggctgggacaggctccttgagaggaaattcgggcactgtacgggaggaaaacacaggacagggaggcctctccccaaaggattgtgatgatagagaccaaagcatctgcaaagagcccagccctacaggggattctctgaacacagcattcctcggggcgtctgtgttattttgccagggttaccataataaagtagcacagactggatgctcagagaaaagaaatgtcttctccactaatctgtaggtgatgttagaatctgagatcaaggtgttggcagggttggtttcttctgaggctgagcgagggcctgttctgtgcatctccctggcttcaggtgcttctggaaggatgtgctgttccctgaattacagacaaacaccccaatctctgcctccatgttcatatggcattttccctatgtgtgtctctgaccatgtttcctcggttttttgtttgtttgttttttgctgttgttgttttgttttgagatcgaatctcgctctgtcgcccaggctggagtgcagtggcatgaccttggctcactgcaacctctgcctcccaggttcaagtgattctcctgcctcagcctcccaagtagctgggattacagatgcctgccaccaccttcagctaattttcatatttttagtaaagatggggtttcatcaggttggccaggttggtctcgaattcctgacctcaggtgatccacctgcctcagcctcccaaagtgctgggattacaagcctgagccactgcattcagccatttcccccttttataacaacaccgctcctgttggattgggagcccactctacttcagtatgatgtcatgttaacccattacatctgtaaccaccccattcccatataagatcccattttgaggttctggggctgaggacttcaatatcaattcggcgggggggagcctacaatgtaaatttgtaacattgtctctgtcatgggccagctgtcaatattccctgaatatccaggatccacccatgctctctggccatcaccagagtgagcaaatccctgacacatggataagagttgcttccatgggctcccagccaggctggaaattcttgattcatggaatcaagaatctttctccagtgggtggggctaaatgcagctgcctccctgacagtctccctgggacactaggcttatcagcttttctcctaaagctgcaggtcctgactgtcctgagccccagctctgctgtggtctttgcatcttaagatcttattcaactcgcttttgtgcctcagtggactgacttacaggaaaacagtgggagatgcccctgctctctctccccagggtctcctcccctcagtggcacaagacctgccctattgactggcagtccccccatgcccatctcaacctccacactgcccactgtgcacggtcacaggtcacaaactgattgttcactttgggcagatcaccttgacagtttctgcagaactgggtgcttcttcccagaatcaggaatttacaaacaaggccagttctagagatgcaactgggagagtaatgtgcatcacagcgaatctggacaagacaaagtggttttgctgtagttctcctggaacacattctggtgatgtgtccatctcccaggatagtcttagcaagttacatccaatgctgcatcaggacccacaagaaaaggaactggcctgcatgagtggccggcagggtcctgggaggagaccctgagatgcccagtgacaggaggagtggattcttaggttggtaagcgtgtggaggaactgcgagtgatgtgctcagccaggtacaggagcaggcgtattggtgacctgtggcctcatcttatctcagttgtctctttagaccaaactccaggaaatcagcacatagagacttctgtctgtctccgagatcatcgcaggacttcacacgtcttttctatttataatacaacatcatgttgtgattgaattactttcatcacagcctcaacagtcctaggtctgaaaactaatacatatacttagaatattaattaaggaatactttcttgtcaattatgtttattaaattaaaagacttcagtatctagtgttacagctgtcctaattcaacagccttgaccttcttagaaataaaatcctgatcccaaatttttctggggatatgactggcacaaggagccaagcagacatctggatgtcccagtgtcactgctgacatgtgcttttttgttatctgtcatggggtgaacagaggaagtgtccctacctctgtccacagaacccatcaaagacagtgcacctgattaaagaagagagggttgtgatcagaggggtccggggtcctgggatgaggtgggaggaggagactcatgggaagaaaggaagcagggcaggaagaagctgaagttcaggctctgaggtgcatctcctgcatggaatcttgactccactcacttctgtcattgtgtaatctttcaatgttggttctgtcatcagtaaacttgaggagaggttatgccataagcatagggctgaggaagggttattataaatatccagtcatggttgtgcctataaaacactcaccaaagactctgaatatattaaggtctcataagtagttgttttgcataatctagtgatacatggaggatggcattcctcctgtggacagcaggaggcactgtgggtgtatcgtttggggatgctaatagctccaagtcccccagtagagctcacgtgcaaagggtgtgactgatgtttcctttcaggtccagtctttttgagtacaatccactctccactcctgacacccacttggcccttctcctgcctttgagaaatgactaccctgaggccatcagctccagggctcagctatgagctcagacagacacgcttgggaatagagaacagatttggattcaatgctccttccttcttgagcttcaagaagaggataagataggagctggttgtgtccaggctccactgggcagcctcgatcagagctctcggaagtgcctcccaccacggcctgtgtctccttctacctcctgcccttcatattctccacaggttggagcatccagagaattcagggaaaccctttcactgctatttccccccagcactggtcctcagtggcattctttccagttctcctgtgcattcagcatcattcatgaaattatatgtttccaggtctctgtgctctgtctgtgctgacccagcccccgtctgcatctgcctggctgtgagcctcagccaaggtcacctacaccagtgaatagtatcaacagagaccaaggaggtccccctagtgtataatggaggttaagagtaatggcagcgacagcaaggggaacaggatccccagtcacttattgggctccagccctggggctgaatgctacttaattatcttcaacctccaatctgaggatgaggccgagtatcactgtggagagagccacatgtttgatggtgaggatgggtgagccacagtgacacagaccaagaagtgaggccaaaacataccccctccccttcctcttcaaggactgagagtgagaagccctatgtcatctccattgaccctgagaatgttgactctccccctttcaaatttcatcatcccagatgtcctccctcaagacacccttaggcagaggcagatgcaggccatgattgaggccattttgataagtcatcaatctgtttccaccacaccagcctgtggggactacactgggagagaccagaacagcccaggcaggaaaacggccctgagagaggggtcgggctgagatgactgcatccagtgagtgccattgcaccctgcacccctgcctcaggggactgtcatggggctctgcctgaggaggcaacatggatcttgacatgtccccagccatttatgagaactgtagttgtgtgcatcctcattaacactcaatattattgtcagtttttgtttaaagccactctaatagatctgtagcgattcttattaattttttaacttgtattttcttagcaacatcaggctgagcatcttttcaggtgcttgttatctgtatatcttctttggtgaaaagcttaatcaaatcttggtctatttttaaaattcacttttccccatattccccttcatgcagtatttttcaaaaatggtgaataaatgaaagttttgctgacatttaaaaactcacagaattgttcaccaccagactgttgctattagaagggtaaaggatatccctagacagaaggaaagtgatgtcacattgaaatgtgaatttacacaaaaaagtgaaaacatcaggctgggcccagtggctcatgtctgtaatttcagcactttgggagactgaggcaggagtattgcttgagcacaggagtttgaggctgatgtgaggtatgatcataccactgcagtccagcctgggcaacatattaagaatctgtctctattaaaaaaaaaaaaggaaataaaaaaattaaatatcaggtacagtaactacatagatacttgtgaaaacctctgtattatgttaatgccaataaaatacagttcactgatcaaagataaattaataaaatacattgtgatttataatgaaaataaaggcaaattatatgacaaagacagcacaaaatctgtggtgggtgaagaacatgttatcaaggtctcatatgggaatgtgtaacaactgcaggtagattttcataagatctctatatacataaaccttaaagtagtcattaaatcaaaccttttgatcaaaaaagaattagagcgaataagctacattagggttatccacagaaacaaaattggtaagatatatatgtgtgtataacatacatatgtgtatatacacatgcatgtatgtgagcatatcgagagagagagagaaacttaaaagaagaaattggttcataggattgtcctgtctgacaaggataaaaatctcttgggcaggctgaaggctggaaatgcaggtaagagttgatgttgcgtcctgagcctgaattcagcaatacaggacttaagaaatcctcactctttgctctaaacacctaaacactttcttttttttttttttttttttttgtgagacagagtctcactctgtcacccaggctgggttacagtggtgtgatctcagctcactgcaatcgccacctcccagcttcaagtgattcttgtgcctcatcctcccaggtagctgggattacaggtgtgcaccatcacatccacctaatttttgtatttttagtagagaccggctttctccatgatgaccaggctggtctcgaactcctggcctcaagtgatcctcctgcctccttggcctcccaaagtgctgggattacaggtgtgagccaccaggcctggcctgctctatacactttctactcatgaatgaggcccaccgcattgtgatgagtaatctgcttatacaaagtctactgagttaaatgtgagtcacatctggaaaatatcttcacataaacttctatgtttgtactggacaaaatcaacctggaaccacatcctagtcaatgtgccacttaaaattaaccatcacttaagccggcatgaagatagaaaggaaccattttttaaagcaatcaaaaacagagacagagaaagggaaagaaaaacaaggaacatatccatagattgtattttttaagtcactttttgaggttttctgttgttttcctgttttctatttcattgatatttggctcttaactatattaataccttttctctatttaaattgaatttcaatgctctccttttccttagatttatgaggtagaaccttagtttattttagatcttgcttctttccactgccaaacattcaatccaatagatttatttaaaactacttacttatatctattttttaaattttaatacatttgtttttgtgttttaaaagttcagtattttctaattttgttgtgatttttttctttgacttatgaaatatgtagttttatcttctttcatttccaaaaaattgaagatttaccacagttcatcatgtatcaattccatttaattagttaattctgcattaaatcataccttgcatgagcttcatattttcaaatttgttaacatttgttttgtggcctagaataggaagtatcatgaaaaatgttccctgtgtatttgaaatagcaatgtttattctgctgctgtgggtatagttttctacgaattcaattagcctaagttggctaatagttcaaatatatattcttactgtttttttgtgtatttattttgtaggtctgtgagagagagagctattgaaatgaacaacactaattgtagaatttcccattgcttcttttgagagaggaaaatttccagtcatggttcttaatactttattctcctgacaaaaggtcacctatgattttccaacactaatcaaggaaaaaaaaaaggcagagttaaagccacactcatggatgccacgggagcagtgggtgaccacatgatgtccctccactggttcagtagatttagcgagacattatattttggcttttaaaaatcataaatctggctaagacatccatgaacaaatttgaagacatacacattgaataaaatatgaaaattaaaagaaaggtaactgcatacgtaaaacattgctatcacagcacctgactcatgggaaatggataaaaagtattataaattcaattacatttacttacacattaaacaaatatgaatttaaaccagttcactaaactgtctcatatactgtttaggtgatggagatttattggtgcacaaaaaagacaagaatacctgctctcagagtggcatcatggaagatggtggagtacgaagctccagcaaatggtccctcctgtgaaattacttgaagtggcaagagtcatgacattaactctcataaaacaacagaatcttgtcccacatttgcagtattcagggatgtgccgatgaagagagagacataaaataatctctgtcaggtcaatttctggccatggaaataattgaacagaaactgcatggatcactctgacaaggaagctggtccttaccaaaatattttggaaatgtcaccacgcaattgaataacagcacctttcagcaagcaacatcagccaaggcagagaagagagacaatctgatttcgagagtgacaatatcataacatccaaaatacccagatctcaagaaaagtttacaaagcagacaaacataaaagaaagcaagacccactaaaaggaaagaaataaatcaactgaatgcattcctcaggaagcacaggcattgcacgtgctacacaaacacttcaaatgaactgcccgtatatgctcaaaaagcaaaaggactccatggaaacagaactaaaggaaagcagggaaatgatgtttgaacaagcatgaaatatcaataatgacaagttttataaaggaaccaagcagaaatactgaaactgcaaagttcaatagctgaaatcaaaatctcaccagaggagttaagtagtggtgtgagcagacagaagaataatcggtgaacttgaagatacatcattgaaattccacaggatgagcataaatttttttagaaaagaataaatgaacaaagcctaagagacatatgagacaacatcaagcatatcaatattgctttatgggagtttcagaaagagaagaaaaacaggaaaggaaaaataaaatacataaagaaaaatagctcaaaacttctaagtttgatgaaagattagaatctatactttcgaggagctcaataaactccaagcaagttaaactgaagtctgcagtgagacacattctgatcaaagcatcaaaagccaaatacaaaaggaaaagtgtaaatagtaacaaaaggagagttggggtagctaaagcaatttcagacaatataggcttcaagttaaaaatgcttacaagagacaaagaaaggcgttataattgatgaaataaccaactagtcaagaagacagaataattatgcaccaagggatagcacttcaaagtacataaaggaagaccaatttgaaaaaaaaaatatgtagatctataatataacttggagacttcacttctccacttttactgaccacctaggccgggcatggtggctcacgcctgtaatcccagcactttgggaggctgaggcgggtggatcatgaggttaagagatcgagaccatcctggctaacacagtgaaaccccgtctctactaaaaatacaaaaaaaaaaaaattagctgggcatggtggtgggtgcctgtagtcccagctactcgggaggctgaggcaggagaatggcatggacccaggaggtggagcctgcagtgagcagagatcacaccactgcactccagcctgggcaacagagcaagactccatctccaaaaaaaaaaaaaaaaaaaaaaaaaaaaaaagataataagagaagagacacaaataagtaaaatcagaaatttgggacaatagtacaaagcttatggaaatttaaattataatagaagaacacacaagcaattgtatgccaaatcttagaagatatggacaaattcatagtaaacacagattgccaatctgactcaagaaaaaagagaaaaaaatcaacagaaatatagaaaataagggatgtaaatcagcaatggaaacttccgaaaaaagaaaaactcaaaaccagatggcctcactggtaattctgctaaatgtaaaaaggagttgatatcaaccataatcaatctcttcccaaaacagattaagaggaagtacttcccagcacattcgaagaccctagcattagcctgacaccaaaggcaaacaaggatagtattttaaaaaaactaaactaaaggctaatattccttaagaatgagcatgcaaaaatcctcaacaaaataaaagcaaaccaaatccaacgttaagttaaggggaataaaggatttcaaagatggttctacataagaacatgaatcaacgtaatatatattaacagagtgacagaaaaagtgtatgatcatctgagtagatgcagaaaaagtgtttcacaaaattcacattttcctgattaaaaaaaaaacacacactcagcaaactcggaatagaaggaaacttctacaaactaataaaggacctttatctaaagccacagtgtacatcacattaaatggtggaagagtaaaagcttccctactaagatcagggacaaaacaaggactcctgcctccacaactactatttgacattgtacagaagttttagtcaaagctcttaggcaaagaaagaaataataggtatctagaatggaaatgaaggagtaaaatcatccctatttgcacagaacccgattctaaacgtacaatatcccaaagaatacacgcacagaaaaactaacaaagtgaataaacacattgaaccaagtttcaaggtacaggaacaactggacttgccacaacttttctttgttatcctgggcattagttctcttggcctcaattttatctttaaaactgggaggcttatactgcagttgagaaaaagacacaaaaagaacctgttagttaaagatggaataagtgaatctcagagggtggacataggttggtgaggtcctgtccatctctgggggcatttttctggagtgtgggaaagcatgttcccagatgtgttagcaagatactcgcaattttctcaaaacaacagacaaggatagtgtagaaatcctcccaccacaaattgtgaacagtgtgtgatgaaataaaaataacagtcatagaaaaagatggcgatgatgatgataatgacttaagtacacaactaaggtttagtgatagaaacatcaggtgttcccaaattcaatgcagcttttcttataaaatgggggcaccagtcttagttcccatatatttaggaattgagggtccccatgaggtgtcgctgcatttctctgggcttttatgtttatcacagaagagctacagcttaccctgcactctccagcccgcaatcaaaaatcatggaccaaagaacaacatttcagcacaagactccattatgggaattgaatctgcccaccctcccgaaaccatatacacctttctgtgctgacatgagaaaaccacagtggatcacactggctcaaagtgaggctggactcctttgtccccaacctcccagatgacaggtgctgtggggtcacccggaggagaaaagctctcctaggctcagtcttgtccaccagcaaggggcagcagagctgcagccaggagcagccagaggctggggctgcccaggtggagcctaaggggtaggcagccctgggaggtctacaggtgtccaaggttcagtcctaggattggaagtcaggacagtccatcctattgcttctggttacagcgaccatgttctgagggtcagactcaaacagcatcacccaggacaccgacaggagccggggcacaatgagagcctcacctgggaaatgcagccggaggcacctgggcccagatgtcagcctgggcagctcccacagtgctggaattccctggaagatgccccaaggttgaggtgctctaggagggggcccagtgggagaggatggggctcccagggctcaagtccttcacccaggatggccatctgagcatcctgccactctcggggcctcgcccctccctctccagcagtgtcctggggagctgaaccctgtcccaggcacttccagggacgcctgacccctcctccctctgcctctccttccagctcgagactgactctgactcatggggcagctcctgtgcgcaggggagtctcaggtgggtggggcggcacattcagggccccggttcctgggtggggcttcccgggcctcctagaggagatgctctccagagggaagggggttctcacctgattcaggccagagctctgaccacaaggctgtccttggctcagtgacaagagtctgctgcattgcagagaccagggaccacccaccatccagagctcacactctgtgcaaaggctgtgtccctgggatatttgcagagaccaccgggcctaaagttgaatttcccatcaatatttcatgtaaacttgtaaaaagcaccagaaaaacacactggactgagaaccccgatgcttttctggggccttttacaagtttacacaaaatactcataggaaaaaataaataaataatggaagagctgaggatggcaatggctgatctatgtggggatgggggatggcctaaaaggagcggcaccatggctgaaatgagagcagacgtccagatgatgccacaagggtgtgtggttgcgtaaatgaaccacctactcctactgaaataattaacaagtatcctgacgacacagtacgttatttagatgaaatgaccaggatgggactaagtaatgctgggggacccagagaggagggggaatatggtgggttcttggtccacctgctgctgagtcaggtttcatcaatgatctctcagcagggccaaactcagccccaagccaggtttctagaaggcccgcagccctgctgagcctggcccaggacagaccacaggtcagagaggtttgggacagtggtcatatggccagtccccaggaaggtgactgtgatcacaggcctcagaggtcgaggctaattttctgaccaaagacccaactccttcttcagtcacctgtgctgcccccacagctagtttgagtgacatctttcaatgaggagtcccagaggatagaaatttgcatgaacaccaagcacttactgccccatagggcctgggaaggaataagagaggcctggggagcccagctgtgctgtgggctcaggaggcagagctctgggaatctcaccatggcctggacccctctcctgctccccctcctcactttctgcacaggtgcttctcccaggccctgccccaggctcagtgcccatagaccccaagttggccctgccctgaaccctgtgcaaagcccagacacagtcttagggtaggacccctgggaatgggctcttgatcttcaagccccctctcctgttttccttgcagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacagcaaacgaccctccgggatccctgagagattctctggctccagctcagggacaatggccaccttgactatcagtggggcccaggtggaggatgaagctgactactactgttactcaacagacagcagtggtaatcatagcacagtgacactggcagatggggaagtgagacacaaaccccttcttcatctattttaccctctccctccagccccaggaccgctgtggaccaacccataagcaggtctggcagaattcacctggttaggagatccttaagctgcttttccctccactcctctaggcagactttgcaggaatgagtcaggagtggatttgggcctggcagggccagactgccctgtgtttccttgcccacggtttgagttgtgaatggagagtatgagtggaaagacagacacagcgggacatccatgcaggcatgaacagcccagagcgacaggggaaactttcagctctcagttcaatgcagtcattgttttatctcttggaagaagcatttctccagtgcaactaagactctagactcacagagcccgaggttgtgggggaggacattaaattttgctcatggatcactaaggacgtttttgagtggagccactacaatttattcattgattcctggactcatggatcctgactgtgggagaaatagtactgcatattgggcactgctgtacagcgcatgccccatcctcaaagtcattgcccaaccttacatgtttttgccatcctgctgccacagtaactgagtcttcaagcagacactgagccattcatataagccagatgccacattggtgaagatggtaagacacttgaatgccatgaggatgggcccatggttgctgtttatttgctgtgatatgagttccttggtcaaagccccctgtggaataccatcatggtgggtgaagcattctgtagtccagagataaaaggtttggcagaagcactgcagtcaaagaaagcaaatccctgtctatactaagtgtgtattctggcaagagcaaagagctatccctgccatgaaggaacagctttaatgaaattaatatcaaccaggcatcctatagggatcttcctgttggtcttcactgttggcagatggtcactcagcagtagctacagccaggtcagctctagtgagtggtagtccactttgatgagtccatggacagcctccttttctgcaaccatagggcatttgttattgagccaattgggcaatgatggcagtggttggggcagactgccaggtgtccagagagccacccatcctaccaacctgtttagcaaaatcaattccttctcatgtcagacttcacaaaatattcacataggagataaatattctcatgctttctgcttgctcacacatctctccctcagacacagttgtgatcaatattctgattgtatttcctgtgtccctgaacatccttgatcatcttccaagtccctgagtcacagcccatgaactaggaacctctgcccgtctctctttgcagatgacatgaaccaggtacactgctctaagttctgccttaaggagagtgttcctccaccactgctgttcagggaagcccagaggccaggtgggatactagcactgtccacagcagggatggctgcatgtcctgcagaaacctctgtaaccccagtctaagtgcctcctcctaggcagctggtcccagggagcccctcaggaggcccaggctgtaaggtgagaggatggccatggggcaggagttggcccgtgtctatctggccacctcttcatgcaacttatttgtccttgtgacctgatccatcaggtctcaggtacagcccagccatgtgatggggaggccactataaatggccacctcggactgggggtcagataacatccagctcattggcagcttgtgtcccatggtgagctctgtggccacagtcacaaagagcccctgttgaggcccaggagcccccccagtcttcctctaatggagctttctgctcatttagaaaaataacaatggggaggttgctcgcctacctcaggtctagggtcactgggaccacctagaccacatccatgatcttgtctgattattctgattccttgttggcttagctatgcattagtgtaaccaagccacagtgtcttaggcactaaaatgccactacttggcccctgcctaccctggggtcctgtcaaccacatcttggtatccaattcagttttagcaccactaagagaaatctatttttatattgagaacaggaaacattagttatttctattgtggaaattttataagacaatagtgtggaaatgttttaagagacattttacttagagtgaaagaccttccattaaaccactcaataaattgctccataaatggccagcccaaaccctgagttcagaccaggcacagcctcggtgttgggaccttctgggaatgggtctctgtcatcaacccttctctaccctcctgtctgcacagccctgggcctcctacatgcagggacagctcccctcagtgtcggtagccctgggacagatgaccatgatcatatgctctggagataacctcggaataaacacgcattttggaacaagcagaagccaagccagacctcaatgtcggtcctctagtataacatcgaccagccctcagagacctctgcttaatttttaggccacaaactagcgaacatggccaccctgaccatcagcagtgcccaggccagggacaaagctgactattactgtgcctcagattgtgacagtgggggcagctggcagggactcacagtgacaaagacagatggggacttgcaacaaactgtcccacttcagcctgcctctcattcttacctgccctctgagcagctgtaggtcaggcctcagaatcaggtgtcctctctggtcctcacctggtccctgcagggccggagattcgtaacagcttttccatactctcagggcctacatgtgttcaataaaacctgtacgggggaagctcgttgaagctgcaaggaccttttacaggtttgtagaacacatgagaacttcaggaatccatatagtgtcacatggctccatgtgtaattacacgtcacacagggaaggagagagctgtttcacagggtgcaatcctactggaattcgtcttttccttgcgtagaaacagcttagtggaagccgtgtctcctctggtttcctagatgagttgaccccacattgtaatggggcacctgaggcctaaggaggacaggagacccaacccctgtgggccccaggagccttcctgtcctgacatttcacagaaactgcagaggaagtgcaggcccaacctttggttccacctggggactgtcttcagggaacactgacctttcccagtccccaaattcccaggacctgtctgacctgactaggtgtgcctccagctccctgatagcttggattttatctctgggctctgggctgctttctgaggagctcactaagaagtccttggtgccaagtgcaggacttgcccctctgctccatatcccgggtctgcaggcacaggggacaggtcctgctaggtgaggctggcaccctcttccaggagggatctctcatcccaggccctagggacaggttcactgggctttcttttctcacttagaatctcttagtctttttgtttccttctttaagagtacaactgctttttggtgaaatcatgtgtatacatcaaagttaacagactactgtcacaagcgcatatatatacacatcctcttcctagatggggtaaccgtggacactctgccatagtcgtctttttgtttctctctctctaccacaagtgagactattaatagcactcttctatgcagaccataatcatattctccagttgcacaagaacgattcttatagttgctcaatttccttgcctttcaggaccctgaagtttcccatgcccacatttggttgccatgtctctctgatccaacagtattccttggaagccgaggcttatgaaacattttgcaaaaagttccacaagaaaactcaagttccttgtgcacagttggaccatgttcattgtgtgcagtagaacctcgttccagtgttgagtccattttatgttttgaccatcaaagggaagggcattatgacttttggggactgagtcgatggaggaaagatagcagtcgatgatgaccttatgcactgacgtgtatgtggccaatgtctatagatggatttggaacttgaaggagctgttcgttctgcagatggaatttccagtgccgcatctccaccacccagccactagcactcggcaggtgctctgtaagaggaagcccttcactgccaatcagccattacacaggtgaaggtgagtgagacttaatagctattaaccctcaaaacaaactgaggaataaactcaggttcacaaagtgactttgcgggaacagcctgaggaagcaagttaattagtagcagaaggttttgcccagagcaggaggaatcacaggatcactgaggacctagtgataccatggtgtggaggtgctgtgaggcatggtgacattcaagaaaacctgttctctacaaacacctacctacccacaggcacagcagacaccccagctatgccaagggctctgtcttcctctagagtaagagcctggtagcaaacaggtatcctctgaaaggcaggtgccccatcagtcagctctgcacgactgaaacaaaaggaaaattgccagagaactttccagaaaacagtcaacctgcttgtgctggtgcattgatggtgacccaggatcagtggaagtaacagtagcttaatttccccatggctgcatgatggacaccgggagagaagtgtggaggcggattaaccaccactctaagtggcttcagccctaggtaagcaggaacaagtgagggggctgagcccacttgtgtctaatcagtcccagcctcagcgactgcatcctggagaccaacagggagtgtatgcgctcagcccctcccagattgctgagcataagcaagaaatttccctccgcacacctgacgcaccacacacctgcccccagctcctcacttacaagacaatatcaaatcagacagggactggtctgggtcccagatcccctcaggttgccgctgtcctctcagatccccacacacagcagactcttcccctcacactcctgttccaggttactcttctccaatatgatgggggtttgctttcattgtttctgtattttttgtatttttatgggtaagctgagccccttttacctggtcttgagtcaggcaggggccacacagagaagaggaattcctccccaggggccagcagtccacggatcaaggcatcagggacctgagcagtaggttctgttcctatgcctggacccaggaggcccatgagcctccagcagtcagtatggagcagccaccaggggggcagcaaagagtcacctgggaaagccacctcgggatggggtggacctgggcatcagggagatgctgacatgcagggagggtcagtgaccacgacctgacacctggagggaaaataggtccttctttttctagagtgttgtccttgacactgatgtaaaaattctagcatcaaattttatcttcagcttttgtagatgctcctatttccctgacaaaggtccaggcacttgacttccccacacatcctctcctcacacacccagttgtgctaaaatgctgtccctgtcatgcacagtgtccttcctgaggtgacacgtgtccccctccctgccctttgctctgggagcccctgtcctgtagacacagcagcttcttcttccctggctgctccccatctccactgtccctgggctttcccatctgtctcctgggaaagctgccaaatcacaggtctcaatttccttgtgaggcacaaaatagttgctcattaaccttctgttgacttaattaagtttttaattccttgatttgttttccccagcaactgaagacaacttagtcataataaacattcacttccaggggtcttgcagtttgctgacccctctcattctctcatggagcaaacattttcttgacctccttatctgtcattggtcctcacagcaccctggggacactgaggcacagcatgtacgacctgccctggagctcacagccaacgaggaaacttaccgcatcccatggatcttccaacactccatgtgcacttggcaaccaagaaattttattcttctctagcactgaggagctgtgccctggggtggggtctgtacctatccaaggcacatgctgtcacctgtagagtgtggatagagggtccttgcattaggttctggaaagtgtcttcaaaaacggatttaggcctacacccaaaatctcctctctggcacaaattattcatgatcaggatacatctagaggcctagaccaaaattcaccacctccctcctgagccagaatggaatggaggaggggactggggaccccagataatttccccatcaccactgtgactctatggccacctcctgcaacagttagggataatcacataggaagggcttcatgtatcctaggaaaaacacccaaagtcatttatgagctctaccatgaccaagtgagcccaggagtcgggttgagcacagcgtggtgtggagatatctgcagagaccgtggaaccagtttgtaaaggagatcctgtaggctgagggtgagagtgcaaggccactcctccccctctctgcatcctttggggctaagcccttctctggaaaccacaaagctcctccagtagcagcccttgactctgctgatttgcatcacaggctgctctcttcagcaaggggataagagagggctggaaggaacctgcccagcctgggcctcaggaagcagcatcgggggtgccgcagccatggcctggaccgctctccttctgagcctccttgctcactttacaggtgctgcccccagtgtcccagccacctacccagctccaaggctctgggtccagcctggcctgacagtgatctcagcagggccctgcctgtggtgtgcaggatgctcatgatcctgctgcagggggaggggctgctggaggtgaaatccccccacactgttcttctgtgctcatggtcccctgaggacacttctattcctgaaactcaggccaggcaggtgggaaggcattgttgggttgagcctctcagtttcaagtctattctattctctccccttttcttgcaggttctgtggcctcctatgagctgactcagccactctcagtgtcagtggccctgggacagacggccaggattacctgtgggggaaacaacattggaagtaaaaatgtgcactggtaccagcagaagccaggccaggcccctgtgctggtcatctatagggatagcaaccggccctctgggatccctgagcgattctctggctccaactcggggaacacggccaccctgaccatcagcagagcccaagccggggatgaggctgactattactgtcaggtgtgggacagcagcactgcacacagtaacacaggcagatgaagaagtgagacacaaaccctttcgccatctatgtcaccctctttctctaattcaaggaggactatgaacaaagccttacgcagatctggttaaattctctttaatctctgcccccagcctgtccctccctccagtccttcaggcggggtctgcagaaagtgcatcagtagttcatttagggtgatgtgatcaggatggactggtgttttggtgactcagctgtgacttgggaaaatagggcctgcatggaagatcagactgaggtagacatccacagttgtctctggatttccataggtggtgacaggccagtccttgccccaaatgtcctagatcagtccccagaactgcccagctcaggctcctgtggtagcctgtcattctttagagaaacaccaatggagtagacactgtgggatctgcccagatcccctgttctgagcttacccactaagcactactgggagcttctggcaggtcagagctgtgtcctcactggaaagtgctgttcggtgcagaaaacagactcctccaggtctatgccctttctcagtgaggttagatttcatgactgcctgaggccgagttctcgactctgcctcaatataggaagacctgaaaatcctcccagctccacagctctctgtaggaaagacttgagacctcaatgagggtcagggtctcctgcccagggttgcctccctcacctcctttcacatcctctgtgcatgcaattcctcatctcagagtctgcttccagggaacccaattaagatcaccagccatccccaacatgggccatgtgggacttcaggaggccactgtatgctggaaagcacctgtttattcctaaattagcactgtgagtatccacacgcccaatgagatctgagtgtttcttgcatttgcatggaatgagaagggagcctgactcgccaggtgctctggggtctaagggagagttggagtcagatctccctgcagggaaacctggggcaggaggagcagccttaccccatgcagggaccacagatgcacccacagggtgagcttaagtatggacactgcctacctccaccctccacatcctgtgtaaaaaatcattctttccacccctcctccagcctatcaaagttgacacttaaaaagccaccacaacccacccttgtcaacaggaaacccattcacatctccatcagccacacaatctccacataaagattcttcaaaaaataataacaatagccatgcaaagtatatgatatatatcataaataattgtacttagattatatatgaaaatgatactctttttgatatgctaggtaaataaaatacattatttaaactcattgacttcttctctttgtatttataacatgatgactagacagtgggattcccatgaggctcacatcacattgtgattgaacaaggctggtctgcagggcttcaggttacaggggctgtggagtgacctggtgcaggaagccccgtctccatccataggacatcagtgtgaacccagggagaggcgctggtataagagagatgagaacacaggtgtgaaccacctgcttgtgcaggggactgagccttcactttgagccaaataagttttctttcccaagttcgatcctgaacaagagggctttctggacttctttttgttttcaggtttgtgccccttcaggtttggggctgtctggagtcccagccaggggacagtgaggaaatccagcagtctcacactgactctgttgtatttcatctgctggggccatcccaaactgctgcgtaccatttcctttcctggtgctcaaatagctgctccatgcacttgtcatggttttatagctcaatctagatgggaagacaggatagtgtatgttacaatatttaaatagaacctgaatcccttaatagttattttaatatggaacattaaaagagttgcatcataggcaatggggaaagatgaagaaagattaaacgcatttggaggaaaaactaaaaatgtctttattgaatgtctgtgtgtcttcagtgacgaagggttgagagaggtcagctttaggttgtcctgaggatgtgctcagatgggggaaagtaagaaagcaggaaacgtgcatctctgtgacctgacacataaatcacagtaaaatggaagtaaatctttcaataaacctttcaagataacatcactctggtgcacatagaaaggcctgttagcaaactttcccttttccctgctggctcatatccccatggatcacctgtatgcagaacggactctgtggtctccatttatcaggctgagaaccagaggctgggaaggacaagtcacctgctcatgagtgggaggggcaggattgggagcagcggactcaggctcaggactgtggccctggttggtgctccttgttcccttcacagggtcccacccacatgtgcccgtgtggatgtgggtgcactgcctggggtggctgatgtgctccagggatttgatggtgcagatgcttcaggacaaagcatgggagtggggatgggacgagctgccgctgggcagaccaaggaccaacgccacccagcagaggcttccagtggggttgggcagccccatttcctgagaatagagagaacctggcaatgagtgccagaaagaagttacttcgaggtgtgcccaggcctggagggtcacagagacacaggcaccacacagcagagacactgaaggccaagagctcactcaggtgaagggcttcaacagatttttctctcctgagcaaatcacgtgcaaagaaatcaacttcctgtcatcagaatagacaatcaggactttagtctccttggctgagccccgctgtcaagggaagcagaagtctctaagcccaggcccaagtgagggtggggtgagaagaggagctcaggatgcagatttgcatggaggtcccgcccttctctgaggcagagggataagacagggctgggggcaggcccagtgctggggtctcaggaggcagcgctctcaggacgtcaccaccatggcctgggctctgctcctcctcaccctcctcactcagggcacaggtgatgcctccagggaaggggccacagggacctctgggctgatccttggtctcctgctcctcaggctcacctgggcccagcactgactcactagactgtgtttctccctttccagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatttccacagtgttttaagtcaatgaggaagtaagatcaaaacctgccctgggctctcaggccccttcttgctctgcagatgcttcctcacgctgtataagggtttcctgcaggatggccttgacaattctcctctctcagctcctctcctttcccaccatgaggtctaaaaggaaacctgctcgtgatttctcgttcaggactgtggcaacttccttttgcttgtgtgctctggtcccttaacgtgcaactattcctagctcttcaatgcagggacgtagggacaaggagtttactgcttggtgcagtccctcctgttttcaggaacatcctcattctaaatgcatcccccatctgccacactatgcagatcaatctggacagaagccatcagggggatggcttccagtttccaggaattgcatcttgttccactctgtgtccaccacgctctaatgaagatggccctcctagctggtctattcctctgcacctgggtcctgaagcagtgaccactttaagaagacttgaagatgtttttgagggattaagaacaaagaggatgctgctgtttttctttttattgctcctgctctttgccgaaattcctcaggttgctgagctggggagattttgagtgacaggctcagtgctctcgcagaattctcctcccctcacatcgctgaggccctgtcctggaaactcctcacaagtggacggtcttcccataggatgggggattccaaaatggctccacaggaaagagttaacctgagtccacctcccttcctcatggacatcgagcatttctaattttcatggctgtcaatacttttgtacctggaatccctaataatctaatggtgagaattgatttagaacacattcggacattagctgggtccaatatttaaattttctgagccagttgttaaatacagctattatcatatatagtttaggctccttaaacttcgattatacagattatatttaaaacaaagtaactagtttactatatatatttacaaagtaactactatataacatcatgttgtgtacctgaaatataaacactaaaatttatttcaaaaaccaaagtgtattgtctattgatgcataaaaaaacactcacaaaacttagcacactaagagaacacatgtctgtgaccttgtgacttggatgcacctagaattgggagtagcttagtttggtcattctcgctcctggttaatcacgaggttgcagccaagctgtcaggccaggctgcattcaggctacatctgccaaagaggttaggaactgtggaagcctccctctggctgtggaagcctccctctggctgtggaagcctccctctggctgggagacttccgcagttcctaacctctttggcagacgtagatcatctcaaggataaaggagagagtggagtgaaggcccctgtccttgtcctccatgtaaaaggccatcccatgcatgcactattttttattctttgctgagacatcctaggcatagagcactgccccattcattcaaaggttgtagagtattctatggtagaattttagccaactcacttttaatggttattatcactattttgatcttataaataacactgcagcgaacatccttatgtagactcctttgattttatatgtagacatgaccatagaataaatttctagaagtcaaattgctgagtcaaaaggatgtgtgcttgtaattttcactcactgtcctcagattctcctctagaggggttatctacaaattcgcaatgtcagccataaatattcgaacagagtacactggggaaagtttaaatgtttttcaacctagcagatttaaaaatgttatctttttttagttttgatttctcctgttctgcttgaagttgagcattttctctaatacttcagtgctatttatttttataatttggtaaacattttcttaaatgtccagataagaaggattttggtctgtggttcccaagagtcaactttgaggatattctgtaggtatttttagcaccatttatagtgtaaccatttaaacctataaaaaccactctcagctctggggccatggaaaaacaggtggcaggacagggatggcccacaggatgtggtttaacggtccctgatttgtagggtaatttgaagtttgagaattccaccgcatatgttctaggtggagatctctatttgaaggatactgtattttacctcctatagtggcctgaggcttttggataagaacatacttgtatcatctatttaattggatcttgggtcttcccaggacagccctgtgtcacagtctcatgtttttcatctcatccatttgctctgagttttcagaaagctttagtatatcagaaatagactgaccctaggtggaaaatcagaggtaccgggagcagcaaatggtcagggaagcttgcaccaactctggaataaaccagtacaggctcagagaaaaacatcataaaatcagcattgtagctgaaaccaaaaacatgcatgatctttgaagttctggggattataaataaataaatgaagtttaaggtttaaatgtgttgcaaatttacataaagcatgtagattttaaaactcagaatgcagcaatgaaatatggaagcttgagattttaagctgttaaggccctacaacaaattgccaggaacagaacaggaacttgatagtcataatgtcttatgctggaaattatcattttctctaaatgaaatttttttcccttttttcttagacataaggaaacatctcattgaacacccttcttttccactgtcaaacacccttacccagaaaggaactgtaacattaagtaggaaacaactgctttttttcataactattgagagatttctttatttgcacatcaaaatgttgattgtcaatgctaaaattggaattagtagtttaatatgcacacaagagattaattttgtttggattatcccatttctgtctattatttgtcttagttaactcagacatattctgcttttggtattttttgttttattttctttgccaactacatgtaaaccaaaaataaaattctaatgctcccccaacaaccccaccatctgagtggactctcttctcttggtgggggcactccaaagttaatctgaaagactggttcaggccatggcagaaaaggggtgtcagacatgtctcattaagcccttttcctttttggaattcaggaaaagccaacctgcacttaacatcaatacaaatcttaagtctgataagaaacatttacaatctattctctctgaagcctgctacctggaggcttcctctgcatgataaaactttggtctccacaacttattataacccagacattcttttctattaatactttcaaccaactgctatcagaaaaatttaaaatctatctataatccagaaggccccacaaccctgcctcccatcaccctcttgttttgacttatcctgcctttctggactgaaccaatgtatatcttgaatgtatataattgatatatcttgtctccctaaaatatataaaaccaagctgtgccccaacctccttgagcacaagctctcagggtctcctgagggttgtgttcaccagtcatggtcactgatacttggctcaggataaatatcttaaaatattttacacagtttgactctttgtcaacatatggctcttttcaaaacaccatttgacacccagacataacccgctgctaatgattacaaaattcaattttattagcatttaaattattactttaaattatttcaagaatgcatggatgtgatttcccccacatctaactcacaaatgttgctgatgctgacttgctcttttctttcagtcttagcaaataaagagggagtttacttttcttgataccagaagataacaggagaaagtaggtgaaactcccgaaagctgttatcgtttccaccctcaggatgaatcacacaaggagtcacctgcacttcatttggatgataaataaatgagatggatcttagagttggtgctgatctagtcaatgatttgggatgttgggctgaggtgaatgtgtttcacaggtgagaaagacatgagttttagagtccacagtgtggagggttattggctgaagtgtgcccgagaattcatacaatgaagctctaatcacagtgcatgaatgaattggaacataggtctttaatggggtgattaagtgaaaatgaagccagtaggatgggttcttttccatctgacaggtgtcctctgaagatgaagaaatttgagcacacagaaatgagacaccatagatgagcatgcagaggaaagatcacgtgaggacacagaagaagggagtgatttgcaagccaaggagatgttacagtagataactaggcagacgtgacagggcaggagaccccctgccccaggaatgtcacgcaagcatcagatgatggtcaggtagttgttaaactgtctctgtgaattaataattagtcacagccggcaccaaggaaaggcggtctcccaatagatagaaaatacctgaagctggtgatcagcagctttctgataagatctcaggccttgggtgagtgggctcaagcaggcaaactaaaaggcaaaacagaggccaggcatggtggctcacccctgtaatcccagcactttgggaggccgaggtgggccaatcacttgaggtcaggagctctagaccagcctgaccaacatggtgaaaccctgtctctactaaaaatgcaaaaattagccaggtgtggtggtgcatgcctataatcccagctactcagaaggctgagccaggagaatcacttgaacctgggagatggaggctgcagtgagccgagattgcatcactgcaccccagcccaggtgacagagcaagggtccttcaaaaaaaaaaatgcaaaatagcagagtttaacctggatctgagactcccatgctgcccttccctccagccctacaggcaggctctgcagagagtgaatcaccagtaaatacacaaacaaatatgattacgttccttttgtttaagaagtagaggaatgattgaatatattaagtgaaaataaggaataccaacacaaagaaaaatttaactgtaagtatggttaaaaatacactgggtgagatagacaagttagatgtcgcaaaacaagagattagcaaactgtatagtgtaacactagaaactattcaaaatgaaacacatagcaaaaaataacgataaaaataaacagcatcaatgagatgtaggagaacttcagacaggctaatatacgtgtaattgaagtcctcagaatagaagatggggtaagaatgaaaagaaaaaatatttgaatgaataatgacaaaatatgttccacatttggtgaaaaccataaactgatataacccagaagctcgataaaacttaagcataggaaacacaaagacaacaactccaaaacacatcataatcaaattaataaaatctagtgatgaaaagtagtcatttaggacaaaactacaaagagcagatttctcattaggagcaatgcaagcaagaagatagtgaagcaatgtcttgaaaataataacatgcaaaatccaacaaccttgaattctttatccaccagaaacatctttcaaaactggaggcaaaataagactttttcagacatgtgaaatcctacagaattgatcaccattagactctcgctattagaaatgataaaggacacccctaaacagaaagaaaataatcctacattgaaatgtggtttgacacaaagaaatgaaaaatcagatatggtagctacctggatcaattagaaacctctgtattatgtaatgtctataaaaagaacagtaatgtctataaagagaactgttcagagaaaaattaataagaatacactatgatttgtaataaaaataaaagcaaactatatgacaaagcagaaaagcgaaggtgggtgaagaacatgtaataatggttttgtactatatgtgaatatataatagcacctgaaggtagattttggtaagttatgtatttactgtataccctaaaacaaccattaaaataaaaccctcaacaaaaaagaaatatggctagtacgctatattagacttgtccaccaaaaattaataggatatgtatggatatgaatatatatgtataatgtatctatatggtgagagagacagacagaaacttattttaagaagctggttcatacaatagtggtggctgatggacaaaatctgttgggcaggctataggctggaaatttaggtaagagttgatattgccgtcctgagttcaaattctgcaagaagctaatgtttccccaagacagcatcagctgttattatgcacactggctccaaatcgaggaaagtgtcccccctgaccattagcagagctcatgccaagaacaaggctgatcattaacatcaatcactgggaaacttcagtatttattctaaaaaccttgaactcattaatgagactcacacacattgtggaaagtagtattgatacaggagacagaaattatttaggcagatagtgagggtgacagggtcctcagcagagcttctcatctaacaaaaagcagccctaaaaatcatttcttttataacaaagagcagcctgaaaaaatcgtgctgcaaacatagataagcaagctggaagcttgcatggggcaatgccagcagctatgccaatagaaaagtactacctgggggtcagccatgtccaacatggaggctccatcttccctttttttgtcaccatgtgtatagcaatagagaaatgggcaacatggagcagctcaggcagataacccacctgcgtaataacagattagggcagggttggccagaaatgtgcaccctatgcaaatggtacacctagtcctaatcagtttttcatgccctgtgcaagtagcacacctggtctaaccagtctttgacacccaccttatgtagatcagatactgcctcctcaccagctcatctataaaattccctacatttcactgcagatccggcaacccatttttctgggtcccctctctgcagcagagagctattatctttctttcacctattaaacttctgctgtcaacctcatttgttgtcagatcatgtcctagttttccatggccctgagacaatgaactttgagtattcaccccagacaatgaggctatttcaatatgcttatacaaagtctactggtttgaatatttatcacatttgaaaaatatcttcatgacaatgtctacactggtgcttaacaaaatcaacctggtaccatgtcttagccaatctgacacttaaaattcaccaccacttaagccaggagctaaagaaaaccaatttttaaaaataaatttcaaaagagagaaaaaggaaagaggaacaatgaacatataagacaaatagaaaaaaagagcaagatggtatattttaacaaagtatattcctaatcacattaactataaatggtctaaataccacaattaaaaggcaggtattatcatctatattctaaaggagttcaggtagggttggtatgctttcttccataaaaatgtgataccagtgaagctatttgggtataggtgggcttttcttagcacggagattttaaattgctactttaatatctttaagtgtcatagacttattcagattttctatgtattcatgagtcaattttcataatttatgtctttccagaaattttacttcatttatctataattttggcatttactgttcataatattccctataaccattctcacccttttagtgtctatagtgatgtcattattttagccatggttttggcaacttgtgtttctttttcttttttttatcatggtcactttacctaaagataaaaatctattgattttattaatctttttgaagagccaagtgttttttttttttttttttgaggttttctattgttttcctattttctatttcatgaatgtttggctgtgatccctattattaccctctattcacttagaatttgaatgttcaccttttttaggtttatgaggtagaagcttagattattttctttaattctttcttctttccaatactaagcatttaatgccatagtttttcttcaaagcagacttagctgcattccttaaattttaatatgttgtgtttttatgtttaaaaaggttcagtatcttctaatttatgttgtgatttttctttgattcatggattacttaacagtctgttctttcactttcaaataattgaagatttcctatggttcttccggtattaattcaagttaattagttaattctgcattaaattatatcttctatgattttcatcctttcaaatttatcaatatttgatttatagcctaaactatgaactatcatgaaaaatgttccatatgtatttgaaaagataacatgtattctgctgttgtgggtgcagttttctacaaatttattataattaagataacttggcaaatggttcaaatctatattcttactagatttctgtgtagttattttgtagatctctgagacagagctattgaaatgaacaacacaaactgtagaatttcccaatgattattttgagagagatcatttttaaaatcatggatctaaataatttattctcctcacaaaatgtcttctatgatttccaaatactaatcaagggaagaaggcagagttaaactcacacttgtagataccacgggaacagtgagtgatcatgtgatgtgcctccagaggttaggctaatgtagttagagtggtttatatttatttatttatttatttatttatttatttatttatttagacagagtctcgctctgtcacccaggctggagtgcagtggcgctatctcggctcactgcaagctccgcctcccaggttcatgccattctcctgcctcagcctcctgagtagctgggactacaggcacccgccaccacgcccagctaattttttgtattttttagtagagacggggtttcactgttagccaggatggtctcgatctcctgatctcgtgatccgcccacctgggcctcccaaagtgctgggattacaggcgtgagccaccgcacccggctggttttttttttttttttaaacacacagttgggctaaaatatccatgaaaaaatttgaagcatgtaccttgaataaaatatgaaaatcaaaaaagttaattgcacacgtacaacattgttaccacggtgcctgccgcatgggaaatgaacaacaagtgttattaattcaattctattttcttacacattcaatgaatatgtattgaaacaaattcactgaatggtcccagatactgaataggtccttgagatgtactggcaaacaagacaaaaaaaaaaatacatgttctccgggtggcctcatggaagatggtggagtaagaagctccaagaaatggtccctcctgtgatataactattgaagtggcaagaaccatcagcattcactctaataaaactatggtatctcatcccatatttgcagcatccagggaagagctgaagaagaaagagacaggcttaaggaagtctctgtcaggtagatctctgaccacagagataactgaacagaaatttcgtggatcactctgacaagaaaggtagtccttgcgaaaatattcaggaaaagtcacaacacaaataaacaactgcacccctcagatgaacaactgcacaatatcagccaaggggcataatctgataatctgatcctgggagttaacaacatcacaatattcaaaatactcagatctcaacaaaaatttgcacagcatacaaagtcacaagagagcacgactcattcccaggaaaataatcgactgaaaatcttccttaagaagcattcatttgctcccatcttctcccttggttatataacacgtccttccacatatacttgattagagcttgtgccccacaaacatgcctggcatgtacattagtgacttctgagagggaggtgggggcaggaaacagtccctctggatacatttcgcatcacatgaaccagtgaacacatctctgcaaggtcctgcattctaataaacaagatttttctgtttaaaagaaaacttaagtctttcagaaaactgcatttcaaaagggaaccttgtctctgctgcttgggctgcagtgaggacagatttactaagtgctggttgctgtgttttgtcttctagtgtgggtacacacatctagaaaagttttaaagaagattggggaacccccacccagcactggtgggactttgagtttgctacggttgtgaacagaacatggaacagaggacaaggtggcccctcctgaagatgagagttttgcttcttgctggaagtccctggactcctggagtgttctcaggggacctcttaacaggatctcaagggaaagaatccagggtactggatccacacaatcaacctcacggatttctgagtaggtcattaacctatcatgcctttagcgttatctcaaattatacatggtatcatctcaactaatgtctaaaacaatatacggcatagatatctaaagaactagtggtacatggaggatggctttctacctctgagccctagaagggactgtgggccttggtttggggactctaatgactctaagtcccctggtagtgctcaagtgcaaagggaatgactgacgctttttttgaggccccttctattgtgtaaaatttattctgtacttgtgacacccacctggtccttcttctgaacatgggaaattgccaagatgaagtctccaggctaacggctcagacaggagctcagataaacatgctgggaagtggagagcaaattgacattcaaagctcctcccaacaagcttcaagaagagggtaacacaagaagtccttgtaaccaggttccacggggcagcctcaagcagagctcttggaagtccctcccaccacggtctgggtctccttctacctcctgcccttcattttctccacaggtcagaacatccagggaattcagggaaaccctttcactgctatttctccacaagctccaatcctcaggggcattctttccagttctcccgagcattcggcatcattcatgaaattctatgtttccaggtctctgtgctctggctgtgctaactcagcccccgtctgcatctgcctcactgggagcctcagtcaagctcacctgcaccctgagcagtgagcacagtacctacatcatcaaatggtatcaacagagaccagagaggtccccctagtatataatgaagtttcacagcgatggcagacacagaaaggaggacaggatccccaattgcttctcgggctccagctctggggctgactgctccctcaccatgtccaacctccagtctgaggacgaggctgagtatcactatggagagagccacaagattgatggccaggatgggtgagccacacacagtgacacaaagggaaagtgaggccaaaaccccccacctcccctttctcctcagggactcagagtcagcagtcacatgtccccttccaagtccctgagacttctgactctcctcctgcagagacacccctaggcagaggcagatgcaggccatgatttaggccattttgacaactcatcattctgtctcctcaacaccagtctgtggggaccatactaggagagaccagagcagcccaggcagaaggaccctgagagagtggccaggctgagatgaccgtgtcccagtgtctcactgtgccctgtgctcccttaccgggctctgccccaggaaaggacatggatcttgacctgtcaccccccatttatgagagttcaatgtgtgtgcatcctcgttagcacttgatattgtcagtttttccttaaagtctttcagatagagctgtagcgatatctaattatgtttttaacttttatttctttaatgacttattatgctaagtatcttttcaggtacttatctgtcctttgtatgtcttctttggtgaaatatttaatcaaatctttgcatttttaaaattcaggtttctcaggttcacatttcctcatgtatttgtatgagtttatatgcatgcatgtgtgtctatgcattccattctgtgtgatttcccaacatgtatcagcacaggtatccaccactacaatcaagacacaaaccaggtccatcacaacatttcctggtgtttccctttgataatatctacctcctcccacccagttccctcccttgcccaaccctggcaaccactgatttggttccctattcctaaaattttgtcttgcaaaaacgtgatacaaatacaaccctattgtagtagacagactttggggttggaattttttacttagcatcattccctataaagtcattggaaaggtgtgtgtatcaatagtcagttcctttcaattgctgagcagtatctcttggtattagtttaacaaaacctgatgaattactcacccaccgaagggtatctggattgttttcagtttggagctactacacctgagggtgctacgaacatcagtttgtatgtttcttgtgaacataagtattcagttctttgaaatgaaggtccaatattataattgctgtgtcatacactaattaggtctttagttttctgagaagctgacaaactgttccctgaagtgaatgtaacatttttttctggccagtaatgaaggaatgatcaaatttctctgcttctttgggaattgtgtgtttttactctttttttaggtaactattgtgataggtgtgtagtgatattccattttttaaaatttcatgtctctgatcgttaatgatgatcaccttgtcctgtgcttatttgccatctgtatgtcctctttgatcacgtttgtgccctttgcacattttctaattagattgtcttttgttttgctcttaactggtattcagtgttgggtgttttgtttttttgagacaggattttactttgtcattcagcctggagtggagtgatgcaatcacagctcactgtagcttggactttcctgactcaagcaatcctcttgcctcagcctcccaagtagctgggacaacacgcacacacactgcctcactaatcgtttacagaattttctttgtagagacaagatctccctatttgcccaggctggccacgaactccttaggctcacgcaatcctccctgctcaacctcccaaggtgttagaattacaagcatgagccaatgcactcggccagttttcactgttctttatgtattttttatactagtcatttactggatatgtgattggcaaatacttaatgccagtctgtagcttctgttcacatcctctcaagagagatttttgcaaagcaaaaattgatggttttgttaaggttcaatttatcagtctttcatttcatgacttgtgtacttggtgaagtctaagaattctttgcatagacatagatcttgaagattttctccttttttttttctttttttttgacagagtctcgctgtcgcccaggctggagtgcagtggcgtgatctctgctcactgcaagctccacctcccgagttcacaccattctcctgcctcagcctcctgggtagctgggaccacaggcacccgctaccacactcggctaatttttttgtatttttagtagagacagggtttcacagtattagccaggatggtctcgatctcctgacctcatgatctgcccccttcgacctctcaaagtgttggtattacaggcgtgagccaccgcacctagccgattttctcccatttttaatataaaaataatagtatcgctgggcacggtggctcacgcctgtaatcccaacacgttgggaggccaaggtgggcagatcacaaggtcaggagattgagaccatcctgacacggtgaaaccccgtctctactaaaaatacaaaaaattagccgggcatgatggcaggtgcctttagtcccagctacttgggaggctgaggcaggagaatggcgtgaacccgggaggcagcgattgcagtgagccgagatcgcgtcactgcactccagcctgggtgacagagcgagactccgtctcaaaaaaaaaaaaaaaaaaaacagataaataaaaaataaatctgagagatggctgagcaatttcactgagtttcatcatggaattctggcctcccaaacaccagcatggcccctgttcctacaatctcctgcttcaagatcaacccaaccctgctacccagaccagatgctagatggtcaagacagggctgtgagagctaaagaatcttcagggtccacgatgaatttacattggagcttccttttccacggatattcacatcaatagagaagatgactgagttcttgcctacctctgtgaatacctgagacatgaactgagatgtgtgtgtgcatatggtgcgggcagcacttcctcactcaatactagggagagtgtgaggaaactggatacagacctggagatagggcacatttttacactctctattaagccctgtccttctgtgctcaccaaggagtcacccaacaaggccacaacaggaagagaagcaggtttctatgaagagacttctctttttgtgatgagggcccaggaagtccactgtctagctatgaactcagaggcagaactctgatgcatctccaccatgacctgaatccctctcctctactcacccttcctgctgtcggcacaggttctgccttccagggctcagccccataagactagggatcagcctggccctgaccttcagctcagcacagggagtgacgcagtgtgtggggctctgagaatgagaccctcatcttcagactcacctctcctgtcctatcttgtaggctcagtggcctcctctgagcggactcagttgcctgcagcgtctgtggctttgggacagagggccaggatcacctaccagggagacagcatagaatacttttatgcaaacttttgtaccagcagaagctaggacaggtccctgtgctggtaatctatggtgacagcaactggcactcagtgattcctgaacaactctctgactccatatcagagaacatggccaccctgataatcaatgggccccaggctggaaacaaggctattactgtcaatcatgagacagcactgatactcatctcacagtgacacaggcagacaggaaagtgagacacaaaccccttcccacctatgtcaccctccccctccaacctcaggaggacagtggtcagagctataagcaggtctggcccagttcactcagatttgagacccccaggctgcccttccctccagccttccaggcaggctcagcagagtgtaaattaagagtggatacacaatgaattattagaattgtatttcagtttttcaagaagtagaggaatgattgaacatgttaagtggaagtatagaataccaaaaaaggactaattgagcttgtactgctaataattacagcatctgagacattaaaaacacactggatgtgattaacaacagatgatgcaacacaaaagattagcaaactcaataatgtagcactagaaaatattcaaaatgcagcacataaagaaaaaataatgatgaaaatgaagagagtgttacagtatatttatagaaaaaatgaagagtgagttataggacaacttcaaacagcctgaggttggctgggaggggtggctcacacctgtaatcccagcactttgggaggtctcggagggagaatccttttgagactagaagctcaacaccagactagacaacataacgagacttcatctctacaaattttttttaagaaaattaactaggcatcatagcctgcagctgtagtcctacctacttaggagcctgagacaggaagattgcttgagcccagaaattcaagatggcagtgagtgaggtacgatcatgccactgcactctaacctaggacacagagcaagttcctgggtctcactctgtggttcaggctggagtgccatggtgcaattacagctcactgcagccttgacttcccaggcccaagagatcctcccagctaagcctcccaaagtttctgggactacaggcatgcatcacatgcctggttaattctttgtattttttgtagagatggggttctccctatgttgcccaggctggtcacaaactcctgggctcgagcaatcctcccgactcagccccgcaaagtgttgggattacaagcataagccacgccacctgatgtgaagaaatatttaaatacaacaacctaaagtatgtataattgacatccatggaatagaaaagatgaggtggagggtcagtagaaaatatatttgaataaataatggccaaatatgttccacatttggtgaaaaccaaaaattggtatatccaagaaggtcaacaaaactcaagcacaggaaacatgaagaaaacaactccaaaacacatcataatcaaattataaaatctagtaatgaatacccactttaaagtttaattccaagagcacatctctcattagaagtaatgcaaggcacagtggaacaatatttcgaaaatgctgaaaggaaaaacttgtgaaccttctgttatttatctaacagaaataacattcaagagcggagggtaaataaaatgttttcagacacataaaaacttacagaattgatcactatcacttttggcattagaaatggtaacagacatccatagacagaaggaaaatcatacccagttgaaaagcaaattcacacgaagaaatgaaaacttcagatagggcaatgacatggatacctatagaaacccctgtattatgttaacatctatgaaagataactgttcaaaggaaaattagtaaaaaaatcactgtgatttattgtgaaaacaaaattaaattatatgacaaacagcacaaaagcagagaggagtgaagaacatgttataatggtcttataccctgtatgaatatctaatcacacttgaagacagattttggtaagttatatatgtaccattaaccctgaagtaattattaaaataaacccttttaacaaaaaagaattatgactagtagtaacctgtattaggattctccacagaaacaatatcaatcagatatgcgtgtgtgtgtgtgtgtgtgtgtgtgtgtattgagagaaaaaagagtgaaagaaatgtattttgaggaagtggatcatatgattgtagtggctgacaaggattaaatctgttgggcatgctgaagtctggaaattcaaataagagttaatgttgcggtcatgcatgcaaatttagcaagccagcacatcaggaaatctccatatttgttctaaataccttcaactcactaatgagtcccacctacattgtgcagagcaatctgcttatacaaggtcaactaattaaaatgttcatcacatctgaaaagtatcttcatgttaactcctatactggtgtttgacaaaatcaacctggcccatatcctagcctatctgacacttaaaattaaccatcatttaagccagaaagaaaattttaaaaatatttctaaaaataaatcagaaaaggaaacaatagaaggggaaaaataacgaacatatgggatgaataaaaaatgaggagcaagaaggtatatttcagtaggattatattactaatctcattaattgtaaatggtctaaatatcacaactaaaatattgtcaaattgaaattaacagcaagactcaactatatatgctacctagaataaacctacttgaaattttagaaccacaaaaagccaaatacaaatcaacgacaatcttcccaacccctggtttcccaacaaagcattacaaaccgaattcacagggattaacacatagttaaaaaatatgtctcacttccaccaacactcttacctctcttcagcctctaatgcctagatcccagtaccagagttgcaagaaaacagggcacacaaatgttaaatcaaggttactaagggtcaccctcaagaggtaggtgaaaagagaatgagggaattgaagccacaagggtcccacttgcatggggcagctcctgcatcacaatgttgattgatacattattgatgagtttttgtccatgttcatggtggacataggtctataactttcttttcttgtcatgactttggctttggtattggagtaatgcaggcctcaaagagtaagtagaaaaatgtttcccctgctgtataatctgaagaagttcttgtaggattggtatcatttcttaattaaaaatttgatagaaatttactatttaaaactgggtgagcttttcttagcaggaagacttttaattgccaattcaataccttcaaataccatagatctatttggattttccatttcttcctgagtcagttttgatcatttatgtcttttaaggaatttttccacttaagtcatttatacttttggcattaattgcttgtaataatttccctaaccattttaacttttgtaaggttggtagtcatggcactcttttatcatggttttagtactttgtgtcctctttcatgttttcctagtcagtctacctaaaagtaaaatcaataggttgtatttatctttttgaagagccaagttttgttttttagaggctgtctattgtttttttttgctatttcattaatatttggctctgatctttcttattaacttttcttttttttgctttgaatttaaatgctcacctttagcctaaatttatgaggtacaagcttagataattcattttagatctttcttctttccaacattaagcattaaatgcaatagatttccttcaaagcactgatttaagctgtatttcttaagttttgatatgttgtctttttgtgttttaaaggttcagtatcttctaatttatgttgtgttttttctttagctcatggattacttagttgtgttctttcctgctcaaataattgaagatttcccatagttcatcaggtattaatccaatttaattaattattttggcattaaataataccttctatgatattcatccactgaaatccactaagatttgacttgtaacctagaacacagattatttcaaaatcatttaaaaatgtgctaaatgtatttaaaagcataatgggtattctgctctcatgtttgaaagtgtaatgggtattctgccattgtgggtgtagttttctacaaattcaattaggataaattggctatttgggaggctgaggcgagcaggtcatctgaggtcaggagttcaagaccagcctggccaacatggtgaaaccccgtctctactaaaaaataatacaaaacttagccaggcgcggtggcaggcaccttaatcccagctacttgggaggcagaggcaggagaatcgtttgaacccaggaggcagaggttgcagtgagcctagataaagccattgcactcaaacctgggggataagagagggacttctctcaaaaaaaaaaaaaaaaaaaaaaaaaaagataaattggctgatcattcaagtctgtatcttgattgaatttctgtatagttgttgtgtggatcaatgtcagggagctactggaatgatttaacactaattttagaatttctgattgattttttgagagaggaaattttcatgggtctaagtactttattcttctgacaaaaggccttttatgatttcccaagactaatctaggaagaaaaggcagagttcaagccacagttggtgataccatgggagcactgaatgatcatgtgaggtgcctccactggttaggtgtatgtaaatgaagattttttaaaaaactaattgggaggccgggtgcagtggctcatgcctgtaatcctagcactttgggaggctgaggcaggtggatcatgaggtcaggagatcaagaccatcctggttaacacagtgaaaccccgtctctactaaaaatacaaaaaaaaaaaattagccgggcatggtggcaggcacctgtcgtcccagctactcgggaggctgaggcaggagaatggcgtgaacccaggaggcagagcttgcagtgagccgagatcgtgccactgcactccagcctgggcgacacagtgagactccgtctcaaaaaataattaaaaaattaaaaaatacaaaacaaatctgggctaatatgtccagaaattttgagaaaatgtatgttgaataaagcatgaaaatgtaaagcaaggtgattgcatatgtataacattgctaccacaaggccaacctcatgggaaagaaacaaaaactgttagcagttcattatgtttacttacacactgaacaaacatgaattgaaaccaattcaatgaactgtcccagatactgtttaggtacttgagatgtattggtgaacaaaagagacaaaagtacctgatctcacagtggcattatgaaagatgatggagtaggaaattccaggaaatggtcctttctgtgaaataactactgaagggtaagaaccatcagaattaaccataataaaatgaggaaatctagtcccacattcgcagcattgaggcaagtactgatgaagaaagaaacaggcataagaaaatctctgtcaggttaatttttgcccatagaagtaactgaacagaaactttatggatcactctgataacaaagtccttgcaaaattattttggaagagtcaactacacaaacgaataactgcacccttgagcagcaacatcagccaagaaggagtagggagacaatctgattttgagagttacaacatcacacattcaaaatacacagatttcaacaaaaacttaaaaagcagacaaagttaaaaggaagcatgacccatttacaggaaaaagtttaatgaactgaatgtactcacaaggaagcaaaggcattggacaaatgacacaaatacttcaaataaccatttacatatgttcaaaaattcaagaaaaccatgcgagtaacaaccaaacaaaactggaagaataatgttagaacaagtgaggactatcaataaagaaaaagaagttataataaaagaacccaagcagattttctagaactgagaagttcaatagctaaaatcaaaatttcatcagataagttcagcagcagtttgagcaggcagaaaaataatcagtaaacttaaagatacattgttgtaattacacagaatgagcataaattttaaaagaataaataaaatgagcagagcctaagagatacatgggacatcatcaagcatatcaatatacgcattgtgggagactcagaaggaagagaaaaaagaaagtataaaatacatgtaaaaataatggctagaaacttccaaaattgatgaaagatatgaatctatactttcaaggagctcagtggccttcatcaggttaacctgacacagactcacagtgaggcacaatatgctcaaaccatcgaaaaccaaatacaaaagaaaaatattgaaagcagcaagagaaagagactcatcacaaacagtagattctcatgaaattaacatttggtctttgatcagaaacaaaacagtccaaaaggcagcacaataatctataaagtgatttataaaaatatattatctaccaattctgcatttagtcaaacaaatcttctaaaataaaaaataaaataagataatcatagataagcaaagtttagtagacctggtagatctgccctaccagaaacactacaggaagtccttaagtctgagaaaagacactacataatttgaatacatgtgaagaattaaagatctcttttaaatataaagctagtgctgttgtattgttggtatggagctgctgtgttttccatgttatttatgagatatatggaaaaaaatcaataattataaagccatgtacataggcacaaaatgtttaaagatgttatttgtgacattaacaaggtctaaaaggagaggaaatggaactggataggaacagaattaatggatattattgagactaagttcgtagcaattctaacaattttaaaacattaatcgttactccaatgataactagtaaaaactaaattgagtgtataagggaaagaaaatgaagaaggaatccaaatggacccagaaaaaaattaatagaacacatgggaaacaattattggggtaatttaggaacaacaacaacaaaagataaaagatatgtagaaaacaaacagcaaaatgacagactttctttgttatcagtgattactttaaatataaatggattagattcaccacttgaagcaaaataacaaaatgaaatttttaaaagtaaaaaaaaaaaatagaatccatgatctatctacatggtgtttatggagaaccaatttagacccaaagacacaaataggttgagtaaatagtaacaaaagaactggtgtggctgtcgtgacatgatgcaatattgacgttaagtgaattatagttgtaagtgagaaaaaagggtattccttattgataaaatggtcaattaatcaagaagatataatagttatacacacgtatgcaccaagcaatagcacttcaaaatatgtgaaggaagacacatttaaaataaaagctagagagatctataatataaattggagacttcagtaccccactttaaaaaagaatagaacatatgaacaaaagattaatagaaaatgcagctattgaacactataatccagctagacctaacagatatatacaaaatactgcacaaaacaaaagcagaatacacatctactcaagagcacatggaacattctccagaatggacgctattttaggccttaaaacaattctcaacagttttttaaaacttgaagtcatacagggagtcatctaaaaccaccaggaaacgaagtttgggtaggggaggaacaatatttccttctactcaacttagatttattggccagcagtccctatcacacaagacagattaaaaaataaactcatgcacatttattaaatataatttttacttggcatgggagctttaataaggaaatgaaaactcagagaaatggctgaacctgaggactttacatttaggtatgatgaggagaatacaggtgtggagaaatatgactaagaatgaagtaaatgcagtaaatgggggaaagagcaaggcctgtgttcattcttctcagcacaccttcattttagaggaaacaatgctctcttttcctcttctttctaatcaacaactcaactttacagctcatggaacaagaaagagaaaagcaaacttaaaccaaagtccacagaaggaaagaaataagaatcattagaccagagattaaagaaatagatgagaaaaaaaactataaagaatataaatggcataaaaagttcctacttggataagaagaagaaaattaacaagctgttaggcaaaccaactaaaaccataagagagaagacacaaataacaaaaataagaaatttgggataatacaaccaacgttatgggaattaaaatgattataagagaacaccataagcaactgtatgtcaaatctagaagaaattgacaaattcatagaaaaatacaaattaccaatctaactgaagaagaaataaaaaatcagcataagaaatagattaagtcggcaattgacaatttctctaaaaagaaaagcccagagccagatgtcctcactggtaattctactagagatttaaggaggaagtaataccaatcatactcaatctcttccaaaaatagatgaggagggaacactgcctagcacattctagaggccagcattagcctcgtagcaaaaacaaacaaggatactataatacagaaaactattggctaatactcctgaagaataagcatctaaaattcctaaattaaataagagaaaaccaagtctaactacacattaaagagaacacatggaatgaaaaagcgagatttatcccagaattgcaaggatggttctacataagcaaatgaatcaacgtaataaacaatatcaatagagtgacaagaaaaagcatatgatctcagaagatgcagaaaaagcatttgacaaagttcatccactttcaagacaaaaacacttagcaaactaggaacagaaggaaacctgcacaaattgattaaagaagggcctttatcaaaatccacagtgaatctcacagtaaatggtgaaagagtgaaagcctccccacaaagatcagaagcaaaacaaggactcctgctttcacagctgctattcaacattgtccaagaagtcttaaatttcattaaaacaaaaaaggctagtgctacctcccaccacaagcatggatcagcgttaggaaattaaaataatggtaatagaaaaattataatgacagtgatgatggtgatggttttttaagtacacaactgaggtttagtggcagaaatccggtacttccaattacagtgcagctgtgcttattggggtgacggaatcaatctcgttttcagtatacatgggaagcaggagtacatgtagggtacaactgcatttctctggaactgtttttcacagaagagctacagtttatcctgcactctccattctgtgatcaaaaaccatgaaacagagaaaagcacttcaacctgagactcagtcacaagaactgcacctgccccaccttcccgcaactatatatgccacctctctgtgctgaaccatgaaggccagaggggttcacatgtggcacagacggaggctggactccctggtccgcaccctcccaggtgacgggtgctctgggatcacctggagaaggcaagtgcctgggctctgtcttttccaccagcagagggcagcagagctgcagccagaagagaggctggggctgcccaggaggagcctatgaaggaggccagcctttgtggggggtggtcaacaggtgttcaagggatcagtcctcactttggaagtttggtatagtccctcctgtcacctggggctgcagtgttcatattctgagggtcagacacacagcatcacccaggatactgacaggggcccaggcacagtgacggcctcagctgggaaacacaactggaggcacctgggccctggtgtcagcctgggcagctcccatagggctaggatttcctaagagacgctccgaggtcaaggtgctctaggagggggaacagtgtgaggggacagggctcccggggctcaagcccttcacccaggatggctgcctgagcctcctgccattctaagggtctcattcctccgtgtccagcagcatcctggggagctgagccctctacacttggcacttccagagacaccctaccaccccctccctctccctctccttccagctccaggccgactctgactcagaggcagctcctatgctcaggggattctcaggtgggtggcgtgggacatttgggatcctggtccctggatggggcattcccagcctccttgcggagatgctctccagagggaagggaatgttcacctgcctcaggccacagctctgaccatgggactatcctgggctcagtgacaagatctgtctggctggagggaccagggatcccccaccctccagagctcatgggtgttcagagaccacgacgctggaaccctcacagagaccaaataacctaaagttagtttctcagtcaggtctgggtttctggtgctttttacacatttatatgaaacactgatgagaaaaaataaagaatcaaagagcagaggatggcaatttctagtctattagagagatggggggtgtcatacaaggagcaactcaggtgagaaacgagactagactgtgtaatgaatccacatgagttgtggctgctcaaaggaccaaaccatggtaatggaaatcaagtttaggatataagtatcctaaagacacagaaccacattctaattaaactaccaggacaggaccaagtgagtctgggaaacccagagctgacttggaggaggaggaagatgatgggttcctggcccacctgctgctgagtcaggtgtcattgatgatctctcagcacggcccagctcagccccatggccaggctcctggaaggtccacagccctgctgagcctggcctaggacacagcacaggccaggatggtataaaacagtggtcatgtggccaaactccaggaggtgactgtgatcacaggccttcaaggatggagtctgatcttctgaccagagaagcagataaagtgagctgggacccacttcttcttcctcagtctgctgtgcttcccacagagctggtttgagtgacatccttcagtgaggagtcccagaggatgccgatttgcatcaaacactcactgcctcaaacggcctgagaggcaataagagagagctggtgagcccagctgtgctgtgggctcaggaggcagagctctgggtgtctcaccatggcctggatccctctcctgctccccctcctcactctctgcacaggtgctgcccccaagcccttccttcaggctcagaacccataggatcctgagctgggcctgcccaaacatgagttcatcccaggcacaacctcagggtgggaccccctgggaacagattcatcatttacaagcctcctctcctgtcctctcttgcaagctcctatgagcttacacagccaccctcagtgtcagtgtcaccaggacaggcagccatgatcacctgctcttgagataacctcaaagatgagtatgtttactggttctggcagaagccagaccaggcccatactggtgatatatgaaggcagcaagcggccctcaggaatttctgattttctgagtccagctcagggaacatggccaccctgaccatcagcagggctcagactgaggacgaggctgactattactgtcacaggtacaatagaaacagtgatgagcccacagtgacacaggcagattaggaagtgagacacaaaccccttcccaatctgtgtcaccctctttctccagccccaggatggctgtggacaaagccatgagcagggctggtccagttcacccagttctgtgacccccaggctgctcttccctccagccctccaggcaggttgtgaagagggtgagttaagaagagatttgaggctgtgtgacaggctatcctggggtttttctggccaaggataaagctggtgaaagagagcctgaatggacgggcagacagagtggcccatgcacgtagtggcaaaagacctgggtttccacatgccagcccttcaggcaggctctgcagagagtgggttaggaggagatttgaggctgtgtggacaggctgttttggggttttctaacccaggataaagctggtgaaagagggcctggatgaaaggacacacaaagcgtatctttcatctagtggtaaaggatgtgagttccatatggtgaagcctgggtcaccccttggcccagacgtcctaggttagtcctcagcatttccctagcacttaagttcctgaatctcctggcagccttatattcaaaacggtgtaagctggagtggacgctgtggggtccacctagactccacgttaaggtcgacccacacactctcagagcctacgagtggatacccatgctgtggggcacatgtcacctgacagagtggctgaccacccctgatctcttctttctgaccacttgggtgtttggcactatgtccatcatggacactctatgggctattaacctatgattcaaagtttcttctgtgtggtgcccgtgcccaaagaccacccacaggcttctgcccatactccacttcccccatttccaagtttttctcttgcagtccctggaacacctgcccaggtcatttcccactgccctaagcccctatctgccctggcatccggccactcacctttcctcacaaaatgaatgaccaggcgccatgccctcatgcaggaaagatgtcccctctccattgtctcttaatgccaccccttagtacacccatatagtgcagctgtgctctacttcatggtgatccagttcattgctgggctactctggaaatttttgctccatcagctgagcagagggactgctacccacacaacgtaagtgtaaacccagggagcagtgctagagcaagagagatgcaaacttggctgtggaccacccacaggttactcagctctggggccctgctcctgctccatcctagctgtgtcacatctgtctcaccagggatcgctgctggggtctgcctgagcacacgacgggggaatctggcagttctggctgcttggtcactgaatgtccgatgctgtcctgtatctaccagggaacaagagcacatggggagagttgttttccaaatgaatataattctctcttgtggatgacatggaattgttccaaatcccatgggattggaatcccattgggaaaatctcatgggattttcccatgagagattgcgtaaacatgagttttcagttcctatcataaattcttccattcctatcaccaattctgtgactatggtagagtctgctggattctgtggtcccaacagcaggacactcatacccctgcctgaacctggtgcagaacctccctgctctgggctccaaaacagtgggcgatgttcatggctcctgatatatgagttggagccacatccccaagggttaaatatgctgcctctagacaccagaatgaccttaaagctttgtgtttctttctggtgggaattgtaagatctaataacgtgctctttattttgtgagagatactaagctgctccagagaactcaatcctaaacatttcagctactacacaggatgaatggtcttagggcttgtttcgcactctcaggaatgcgtgggtctcaccaaagcttccaatagacagggccccctcatgcacatctgatccaaatacagaatagagccctaggaggttctcctgggtgttcagatggtcaaagcccctatgacaatatcatgaaaaagaagggagagttaatgaagttgaaaaaataaaagtataaacctatactgctgtctactccttgtatgcacaccgtttctgatcctgttctgagaggaatagaatgagtttctgcattgatggtgcctgctgtgcacctgtagccatgcatggtggtgtgttctatcagggtcttcatctggcacagcaatggcagatggaactaccagctgactgcgtctgtagaaatccacttccatcttccaggatccattcaacaattgtaggaatcatttcagtaaaccaaacacaagagcctcaactataactacaagtcctccaggagaggagaacgctgtctcagagggtgcattcctactggaatttctcttctctttgggacaaaccagcccagaggaggcacaggggctgtgtgtcatctggtttcctagatgaggtgtctcctcctcactgtcctgagattttgaagaaactggggagattggtgcagacactccttggatccttacaggaaacttccttcagaccacacactcctcaatttgttcccaagctccaaagtttctaaagtcactgtctaaagggcccacagtgtttttgtggagtggtggaaaagctctggggatggaaagtggtggtggttgcaaagcattctgaatgtacttactgttgctgaatgcacacttacaaatgattgaaatggtttaaaaattgttcattttgccataataaaaatactgcacactctggaggaaagtaaacctagtttaattttgaaattgttcaatggataccaatcaaagaatagtgtagcaagcaccatttcccctctcgctatagcagcaactgatccccttgtgctcttttggactctctcccctgctctctctctctcaataataagcaatgctcttctctccagtccaagctcacacttccccagttgtgcaggaatgcctattgtaactgttaatttatttccaggcagagtcctcaagattcctctgctcatattctgttctcagctgtctggagccagcatgacaagtgagccaagatcacttgtcatgagagacttgtggaaggttttgcaaaaagttccccaagaaaaaacaatgctcattgttgacagcaggtccatttccacacagtagggccatgctgggtgtgcagtggggctgtgcacactgtgcccacaggccaggctctgcactgctgactctgatcctgtgcttggtaggaccttgtgcactgctgagtccactgcagactcgaccctgaatgggaaggtggttcctagctgctgggcactgagtctcatagagggacagatggtattgaggatgcccggcccctgatgtacataaggggacaaggtctgctggtagaacaggaagatgaaggaacctgtggctctaaaggtggggtctccagccctcagtctcagctgcccatggcctcatctgtgtgcaccttgtcaatccagaccatgtgaattagaggtgaagggaattgaaggactttcccattttctcccattttctctcttggttacagaacgcacccttccacatatactgtattagagcctgtgctctacaaacatacctgacactaaattagtgacttttgaaagtgcagataggtacagcaaccagtccctctggagacatttcccataacatgaaccagtgaacccatctctgaaagccctcatgttttaaaagacaagatttttgaatttcaaggaaaactaaacctttgaaaaaaacatgattcaaaagagaaccttgccactttccattcctgcttgggctgcagtgaggacagatgcagcaagtgcttctgatgtctgtgtctgttcccctgtgtggacgcacatatccaggcgagtttcagtgaggtaggagacttcggcagcattggccgggctctggtttgcttctggtgctaacggaacatggaagagaggacaaggtagcgtgtcctgaagatcacatatttcctttttgcaggaagtgcctgggctcctggagtgttctcagggctttgatccaggccaccggctccgcaatcaacatcactgatatttcagcaggtcattgacctaattccattttagtgctatctcaaatggaaacattattttcttgtaactattcatatagcaacatagcacttaaatatctaaataacacacacagaaacagtagtctcaaatgcaaagctgtcacctccccacaccacacactttctcacccgagcccctgagcccacccttccctcggccccccctctcctgtgctgttagaaatctctgtcttctaacagggacagtgacacaaaacagccccccctcccgcccagcactcacaccgcagagcccctagtccatctcctgagggaacgtttacgtttctattctgacagagagaagtcgccgtgaatggagtctttaccccaaacccaggagtttctgaggaacacatggggtcagccactgtctgtgtggggaggcttcacctcagggaggcgcccggctctgggctgagggggactcaacgtgcactaaaaggcaggactaaggcaagtcccgggtcacagtgtgagggacgcacgcgccctgaggaggggtccctggtgctaggcctgacccaattctaaccccaggcacctttcctcagctcctgtggccctgggacacctccctaccctgcttcccatgaggctggtcacagctcttgtgagcaccgcctcctccatgtcacactttttctgtcaacattttgaggagccagttggttttctcctcattccatgttcctgtcccacctgcctgctgggggtggatttatttcatgtatgaggtttcctcagcctgagccacagctgcctcaaggacaccaaccctgtgggacactcctctgggaaaagcaaacaagtgccaagaggagcatctgaagctctggtgtgggagatgtcctccaccctgggtcaggggagtctggaggggatgagaagggaccaggggcctgggattgagctgtgaagggaaccaaaaggcaggagggacagggcaggggctgtcagctatgactcaggggaggttcctgggcctcaggatcctccctctgaggccaccagggggcgggggtggcacatgcctggacctgggaggtccctgctgggcttcaccctgggtgggtcctaggagctccttcctcctaagtccccctaaagagacagaggcattctggggtcctaaatctgtcatgcccccataaatgcatttctacgagggccaataaatgaactccaggtttatccaagcagcagcttcaggcgtctgcagacacagagcggggaggaattagccaacctgaggcaccctagaagggctgaagggggctgaaggggactgaagggtccctgtggggcctgtggtcctggggaggggagagctggggtgtctcccagccactctgggccctgtcctgacacttctcccacaaagaagggaagggaaatcctgggaccccacagccaggaccaaccgtgaaccacaggacaggaaggacagggacccccaaggctggctccatttcccaggcactgtcatgggctgagtctcaggaaatccaagtcaaggagtttcaatccccctggctgagccccactgtccaaggaaacagaagtctacgggcccaggcccaggtgagggtggggtaagaagaggagcttaggatgcagatttgcatggaggccccgccctcctctgaggcatcagggtaagacaaggctgggggcaggcccagtgctggggtctcaggaggcagcgctctggggacgtctccaccatggcctgggctctgctcctcctcacctcctcactcagggcacaggtgacgcctccagggaaggggcctcggggacccttgggctgatccttggtctcctgctcctcaggctcacctgggcccagcactgactcactagagtgtgtttctccctctttccaggctcttgggcccagtctgccctgattcagcctccctccgtgtccgggtctcctggacagtcagtcaccatctcctgcactggaaccagcagtgatgttgggagttatgactatgtctcctggtaccaacagcacccaggcacagtccccaaacccatgatctacaatgtcaatactcagccctcaggggtccctgatcgtttctctggctccaagtctggcaatacggcctccatgaccatctctggactccaggctgaggacgaggctgattattagtgctgctcatatacaagcagtgccacttaaccacagtggtccaagttcttggggaactgagacgaaaacctgccctgggctctcaggctccctttttgctctgaagatgtttcctcacccagtgcaacgggcttcctgaagcacagccttgagaattcttctccctcagcaactctcttttcccaccatgaaatccaaaggaaacctgctctgtggtttctcatccaggacagggacagcttccttttgcttgtgtgttgtggtccctgagtgggtgcaactcttcctagctttttaaattatgggagggtgacaatgagctccctgactggtgcagtccctgctgttttcaggaacatcctcatcctaaatgcatctgaatctcccactgtgtgcagaccaatctggacagatgttattagggggagtttccagaagccacatcttactcaactctgtatccaccacactctggtgaagatgcttttttggtgcccatcctcttgggtaaagtccactctctactcatgacagccatgtgtcccatcttctgaacttgggaaattgccacaccaaaccctcaggctcagggcccacataggagctcagaaagacgcactgggaaatggagaagagatctgcatccacccctcagtggagagacacctaactagataataagataaggaagtaggtttgcatgatgagtctccccttcttatgataagagagacctagagacccccttctcaggtgtgcgctcagaggcagaactctgaagcatctccaccatggcctggacccctttcctgctcaccctgctcactctctgcacaggtgctgcttcccagggctcaacccccacagcaccagggaacagcctggccctgactttcagctcatcacggcagtgatgcagggtatggcactctgagaatgagaccctcatcttcagactcacctctcctgtcctcgcttgcaggttttgtggccttctctaagctgactcagctgcctgaagtgtctgtggctttgggacagatggccaggatcacctgccatggagaggacttagaaagctattatgcacactggtaccaacacaagtcagtccaaacccctaatctcattgtatacaatgatagaaagctgtgctcagagatcactgagcgattctctggttcctgctcagggggaacagccacactgaccattactggggctcacgttgaagacgaggctatttttgtttttctggagataaaaacacattcatagtgacacagacagatagggaagtgaggcacaaaccccatcaccatctgtatcactctctttcttaagccccaggagtattgtggacaaagtcgtgagcagggttagcccagctcagctggatgtgtgaccccgaggcacctttcactctagtcatccaggaaggctctacagagggtgggtcaggagaaaatttggggctgaaaactaagctgtcctggtgttgtttagctaggtatgaattggcttaagatgacctgactggtaggacagtcacagcaagataaccattgagtaatcatgttgcctggatttccttttgtttaatgaccaaacctaaggtagctctctggtccaaaatgccctggattagtcccctggactcctcattctttaactgagacctttgatcccagctgtcatggcatcatgatgtcgtgaacagggaagtccattgtaatggcaactgtgacatcaggggtcatttacccactatctacccaaggccgcagggaatccttggcttctcacagctttttctcaccggaaaatgccattgagtgcagagtactgtgtcttccaaggatgtgccccctccataatgtggtttgggagcaatgattgcctgatgcctagattccaaagccatgctttaattcaggatgaccttgaagtgcctcctgctgagtgctcaattgtaacacattcccagaagagcctcccacacttattttctgggactatatacccgaaccctactgcatggaattcaacctctcagagtaactttccaagaaacccaaaaattaaaaactaaacaacaacaagaaaacaatatagagagaagagtatcaaagaaaagcaagttgtacaaagagagaactctggagtcttcaaatattaataagcatcaagcagcacatgtgtggacggaaactccattttcagacaaacagcagtccaaagacactcgcgggaacactccacagagcattctttctctctctctctctctctctctctcacacacacacacacacacacacacacacacacacaaacacaaaatatgaatcctgcttgttcctacagtcacagaggaaaggcctgagttaaggagcatgaggtcgaatcctcggaacagctttgcctcagtcctggagaaaatgtcagcctagacaataggctggtctggtctcaactaagtaagttaaaaagcaagttttaaaaagtaccaagtttccgagtaattatactaaatccaagaataaaagaccaaatagacagagaagtgcaagtatattctaaatccaacaaggaaaaactcaaaatgtctagcacctatcagatttccttgcaagaaccaagaaaatacatgctataaaaagcagaaaagttcatcagtccaaagtctccctgaaattgcacagatgatagactttgtaggaagaatacaaaagcgatacttataactatcttccacttgctcaagagggtacgggattgattgaacatgttaagtggagacacggtagacataaaaagatcaaagttgaacttacagaaattacctctaaaatgtccgcgataaaaataaatacataaataaataagggccaggcatggtggctaatgcctgtaatctcagcattttgggaaatcatggtagaaggattatttgagcccaggagtttgagaacagcctgggtgacacagggagaccctgtctctacaaaaaaataacaaaatcagatagatgcatggtgcacacccatggtcctagctacttaggaagtggtggaagaattgcttgagctctgtaggtcaggatggcagtgacctgtgatcatgccgctgaactttggcttgggtgatagaatgacaccgtctcaaaaaaaaaatgtctgagaataattgtagattagctcccgcaaaataatagattactgaacctgaagatataacaatgaagctcttcaaaatgaaacaccaaaaaagagaagataaaaaattacactgagcatcaatgagttttacgacatcttcaaggagccttaattgtataattaaatgaactaaaggagacaagattggtggagggagagggagggtacaaaaaccacttaaagaaataaggaaaaacgtgcaaaatttggtgaaaactataaacttatgatttcacatagtttaacacaacccagacacccacacacaaacacaaacacacagacatcatatacacaaaaaaacacacacataaagaaaacatcaacacccgccataatcaaattgcaaaaaaaaaaaaaacaaaaacaaaaacaaaaaaaaactgtgatggagaaatgctcttaaaagcagccagagagaaaagacatgtttgatgcaggtgaacaccataatgatgagagtagctttcccattagaaacaatacaagcaagaaggcagtggaggtacattcataaaactttttaaaacttactacgcacagcattgtacatattcagtgtaatccctatcaaaacaccgatgtcattcttcacagaaatagaaaaaaaaaatcaatcttgaaatttatatggaattacaaaagacactgaatagccaaagcaatagtgagcaaaaagaataaagctgcaggtgtcacaccacttgttttcaaaatatgctacaaggatatagtaacccaaattatactatactgttttatagtataaaacagacacagaccagtgtaacagaataggaaacacagaaataatccacatatttacagacaactggtttttgtcaaaggcaccaataacatacattggttaaaagacagccttcttggtgctgctgagaaaactggacattcacaggcacaagaattaaaatagacctcgatctctcaccacatacaaaagtgaattcaaactggattaaagacttaaatgtaaaacttgacactactaaactactagaagaaaacacagggaaaatagggaaaatgcttccggacttatgtgtagacaaagattttatacctaagctttcaaaagcacaggcgacaaaaacaaacatagaccaatggagctacattaaactaaaagtttctgctcagcaaagaaaacaataagcaaagtaaagagacaacttgtagaacaggagaaaatatttacaaactgttcatctggcaatggattcacatacagaataagacaataagacaagaaagcaaaacaattcaacagcaaaaaaaaaaaatgccaaataataccattaaaaagaggtcaaagaatttgaatagacatccctcaaaagaaacatacaaatggccaaagggtgtattttttaaaatgctcaacatcactaatcatcagggcaatgcgaatcaaaatcacagtgagacatcatctcaccccagctagagtgactaatatcaaaaagacaaaacataacacattctggcaagaacgcagtgtaaaggaactcttatacactgttatatactgttggtgagaaggtaaattttaaattaatacggccattatgaaaaacatgatagtgtttcagaaacactaaaaatagactatcatcatacaatgcaataatcccactactgggtatttaatcacaggaaaaaacgtcagtatatctaaggaattcctgcactcccacgtttactgcagcactattcataatagcaaagctatagaatcaacctgttttcatcaacagatgaatgcataaggaaaatgtggcatgcatacacgatgaaatactttccagtcataaacaaaagaatgaaatcttatcctctgcagcaacatgatggaactggaggtcattatgttaagtgaaattagccaagcacagaaaaacaaatgtcacatgttctctctcatgtgggagctaaaaaaagctgatctcatggaggtatagtgtagattaatagttaccagagaggctgggaagggttaggggttgtggggatgaggggtagttggtcaatgggcacaaacatacggttacataaaagcaataaggtctattgttgtatatcacacagcagagtgaacatagttaacataatttattgtacatttcaaaatacatagaagatttgaaatattcccaacatatagaaatgacaaatgctcaaggtgatggatatcctaaacactaattcgatccttacatactgtattcatgcatcaaaatagcacgtataccccataaacatatacaattataatgtatcagtaaaacatgttctttaaattaaaaaaaactgtcaattctgaattctttactcagtgaaaatatctttcagaagggaaggcaaaataaaatggttttaaccataaatatacttgcactattcatgacctgcagacacacactatagaaaataataaagaacacttctcagatagaaaatcatactaaagatgtgactctgaataaagaaaacaaaaacatcaaatatagtaactacataaaaacatatagaaatggtaaataaacatagatataaacgacttaaattacattacaaaacaactagacttaatagacaactatagaacagtccatccaacacagcagaatacataataatctcaagtgcatatggaacactctccagggtagaacctgcaaaaaaaaaatgagtaccttaaaaaaatagaaaatctataaagtatattctttgtgttacttcactcttgtattgctataaagaagtacctgagcttgggtaatccataaagaaaagaggtttaattggctcatggttatgcaggctctacaggaaatctggtgccagtatctgctgctggtgagggactcaagaagcttacaattatggtggaatgtgaatgaggagcaggcatgtcacatggtgagagtaggagagagagaggtggaaagtgccacactcttttaaacaaccagtctcacatgaactgggagcaacaactcattgtcatgagggcagcaccaatttattcacgaaggatccacgtggccccatgacccaaacacctcccactaggcccacctcaacactggcagctacatttcaacataagatttggatgggacaaatattaaaagtatataattccacccctggcccaccaaatctcatgcctttctcacattgcaaaatgcaataatcccttctcaataatcccccaaagttctaagtcgttccagcatcaagtttaacatcctaagtctcatctgagactaacctcctgtcacctatgagcctgtagaatctaaacaagttatttacacctaagatgcaatggtggtacaggccttgggtaaacattaccattccaaaagggagaaaacaaccaaaagaacaggccccacacaagtcctaaacccaatggtgcagtaattaaatttcaaacttccacagatctctagggcatgaaaagaattcagccaagctttttactaaggcatcacaagggtgaactttgctccagttcccaataactatctcattccatctgagacctcagcagcctggacttcactgtccgtatctctatcagcatcttggtcacaaccagctgaccagtccccaggaagctccaaactttccctcatctgtctgtcttcttctgagccctctaagctcttcaaacctgtactttttacccagttccaaagctgctttcacatttgcattatccttacatcaacaatctacttttggtaccaattttctgtgttctttcattcttgcatttttatagcacctttatagcaccgctataaagatgtacctgaggctgggtaatgtataaggaaaagaggtttaattggatcactgttctgcaggctgtataggaagtatggtgccagcatctgcttctggtcaggcccttaggaagcttacaaaaatggtggaaggtaaagtgaaaccaggcatgtcacatggcaagagaaacaaaaagaagaaagagagaaaggaaaggaaaggaagagagggaaggagggaagaaagaaagaaggaaagaagcaaaaaaggaaaggaaagaaacaaaacaaaaggaagaggaaggaaggaagagagagagagaggaagaaagaaagagagagagagagaagagatgagacgagacggggggggagagaggcagggaaggagagagggagggaggaggaaggagggagagagagagagtgaaagaagaaagagagaaagaaagaaagagagaaagaaaaaaagaaagaaagagaaagagagagaagagtggggaagtgccacactcttttaaacaaccagatcttgtttaaactagtggttagaattcattcgttattatgaggacagcagcaagccaatcatgaagggtcagccctcatgacccaaacacctcctactaggcccacctcctacagtggagttcatcttccagcatgagatatggaaggaataaacaatgatatcatcctctgaacactgatattgaaaaataaaaggtattatatgagaacactgtgaaaagctgcataccaaaaattagatgaaaagaaaaaatccctaaaaacataaaaactactaaactggctcaaggaggtatagaaagtctgattaacactataacaagagtttaaattagtcattgaaacctcccacaaagaacggcccaggcatgaagggtttcattgatgaatattatgaactgtttaaggaattaataataattattcataaacccttccaaaaatataagaaaggggaacatgagcagctcattctatgaggccagaagtatgctgatacaaaaacaaaagacatgaaaagtgaactggagcacaacagcctctatgaaaacagatgcaaaacaaccacacttcaacaaaatactagcaaaatataaaaaggattaaacaccataactaactagtattcatccccaatattcaagggattcttaacctatggaaattaattattttaatgctccctattaaagaataaaaccacatggttatttcaacagtcacatcaaatgttttcatgtacgcagacaggacttcctgttgttttcccattcctgttaaagcatcataaaaggcacgatttgtggtgctactggatggggtgctacttcatgcaaactggatatgtcatgtccaaccatgaatatacttagccataaatgctaaaagattgtaatttggtgtcagagacttggtggtcagtgaccacttccttggcaagtggtaagtacagacatctgaaaggataactaggatttaggtaggtattggataaggaggtgagttacacacagaaaaagtttcacttaaaaactcatagacgcttgaacacagaagatggctcaataggtctgagaaataaacaaagtccagaataactggagctgaatggaaacaaggcaaatgacatgaaccatctgtttctctctcgacaactcactggggcattgtctcctccctataccacccacgtggattgtaaaaacatctgttcttaaaactttcttgtgcatcatgacagcatgtagcacctgaatccagctcagttaaatgagggcaggacagtcaaccacaaaacccaggtggcccaggaagcacatcagggagacaagaccttgctgtcaaaagcagaggaagtgagattttccattgtggctaagcccagagcatatgaaatttcaatgggtacacaaaaaccatatagggtttggttaagctgcagatgcagtctttgcaggtttgaatggggccccagattctccatggcaaatagcctccagttgaggttgattgatgctggtcctccaaggaacacactttgggtggcttagctcctatgcaccctcctcactcatgcacagctgaaactcacctacataacgcaccttctgagaagcataagtgacctatttctcctccactaatgtgtctcagtcccttttactaaaaaggaatatctgaagttgggtaatttgtaaagaagcaaaggtttatttgggtcatgcttctgatgtctgtaaagttcaacagtgggcatctgcatccagtgaagacctcaaactgcttccactcctgacagaaggtgaagatgagccggtgtgtgcagaaatcaattggaaacagaaagcaagttctttcctaaaaatactgcaggagtttaatgatcatatttacaaagtgtttaacacagagcctgacacaccctagctgctcatgagttggcagcaattattgctgatgtcattcatgaaaattggacctcagatggagaaactgcagtgcagagagtttgagaagtttagggacaagaaagacttagtgacttaaaatcgagttctaggaactgaggagagcatccctgggcattttactgccatcttttccaatgtctcagaaactgtttcaatgtgacgtcaaccagagaggaaagcagaggggtttgcagaaccaggggctacaacttcatccacgggagagtgatgtagtaagcgggtgggaaggggcagctgagctcatctgaagggtgtttaaggttttctggcccagggatctttggccatctctccctgcccagggcctcattcttccactgaccggcaggagctggagagtggcttctgagtctggttagagatcccagcagcacccagagggggaagacattggagagacgggtctaaggtcactggagacactgtttgctgcctagagggctgcgacaggctccttgaaaacaaaattcagacactttaggggaagaaaacacaggatgggaaggctcctcaccaggggattgtggataacagagaccaaagcatctacaaggagcccagccctactggaggtgccctgaacacagagatcctaggggtgtctgtattattttgccagggctgccatagcaaagtagcacagccctatggctcaaagaacacaaatgtattttctcactattctgcagatgatgttagaatctaagatgaaggtatctacagggttggctccttctgagcactggagaatctgttccatgcctctcccagcttctgctggctgcggaggtgtttgctgttccctgccatggagggaaatcaccccaatctctgcctcacattcaaatggagtattcctcatgtgcgtgtctgtgtcacagtttcccctttttataaggacatgagtcgtgttggattgggtacgtactctgctgcagtatgaccttttcttaactaatttcaactgtaatcaccctatttaaatataaaatcccactctgaggtccttgcagtgaggacttcattatacaaatttgaggggactgaaattcaaattcctaacagtgtgtctgccatgactcaggcctctccttggggctctgcaggtgggatgtgcaccaccaacctctcaggtggggcattacctgacagcccagaaggaccccaggccctctgaaaaatgacgtctctttcatccaccttgagggacatgttttctggctgtccttctcatcctttgcatgctgacatgggagacatcatcctctgctttttaaagaaggactccttcaccttcccaatcaccccaagtagatgcccatgctggttccacagaatcaaaccacggtgggttacgagttatattagccaccagctgacaatattccctgaatgtccaggatccacccatgctctctgaccatcaccagagtgagcaaatctctgatatgtgggtaagagtttctcccatgggctcccagccgggctgtaagtgaggcaagaccccttcttcagtgcacggggctcagtgcagctgcctccctgaccaagtcttcctgggacactaagcttatcagtttctctcccccagggacagtttttggttgtcctaagcctagctcagctctgctatgaactttgcatcctaagagcccattaaacacccccttgtgcctcaatggaataacctggagtaaatagtgtgaggtgcccctgctttctgctcccagggcctcttctcctcggtggcaccagcactgccctattgaccagcaatcctcacctgcccattcaggcctctacactgcctaccgtgaacagtcacagatcacaaactgattgccaaatttgtgcagatcatcttgacagtttctgtggaactgggtgccttctcatagaaccaggaagtcacaagccaggccagctctagagaagcaactgggggagtaacatgcatcacagcgcctggacacaacaaagggattttgctgtagtcctactaggacacatcctagtgatgtctctgagaaccagtcttggtccctgcaacagaaagcctactaaacaggacagtaggctgcaaggttgggcacaatttgtgccgtgtgtgagccatgtagattgtgcatgtgtgtatgtgtgtacatatgtgtacatgtgcatttagtgttgcaaggaagggttgtgtcaaatgtcccaactcaaaacttttctgttttcctaagttatctgcttctatctttactacctttgtactatcataagaataaggataatgattagggttgaaataggagaaggaataatgtttaattattcattcttatgtgtttaatacatatcaagcactcttcaaaacaattcatatttattaaatcactcaatacgaactactccatgagccaaatattgtcattatctctccatttccagttggagaatctgtgatacagattttgacacatgggaaagctaaggcaaagaaaggaaaaggactttgcccgatgtcagaactagaaagtgcctgacccaggagcagaacctgagtcttccagtcccagagaccctgttctttaacaacagcctgtgggcctgtcactgtgctttaaggtaaagcactgacatctccctaagactccagaaagttctctgtactttttgaatcaagtaactcatacttgcagtgatttccaatgcagtaggaattctctggtgctgaggagtctactaggaatataatttcaatgcctttaaaatttttcagtagccacattttaaaagtaataaagaacgggtggaagcaactttcgtactatattttctttaactgagcttacccaaatattatttcaatatgtaatcaacataaaaatattgagatattttatgttattttcctacaacctttttgaaatccggtgtgttttacccccacatcacatcttaacttgaactacccacattttaaggactcagaagctccctgggactcatggttgctatactggacagagcagatccacatgaatgatgatccatttggatcacagcccctgcagtacttacttagaaccatcttggggcaatggagagtcctatgacccagagggcctccttagggaagaatggctgttccattttccaaccaaagtagaaatatggcgggctctcagaaaccagggaatttttacaatgtgtttcacacttcttcccttctcaaagacattgactataacttccagttcgaagataaatctgagccatcaaaggcatttttttctattggtcagtggaatgaatggcaatggtccctgtggattgtgctccaaggatccctttctgtgggaagattcttacaataaaaccaactaaaagtaggaagttattgtttatatgtagatctagatgaaagggggctgatcatgaggaatatagtattgaaggtgagtgtgttgctattcttcacaaagggctatttttgcctaactcacaagcatcaatcatttttatgaaggtgtattttcccagagtggtcttagcaagttacatccaacgctgtatcaggacccacaagcaagggtgtcagaactgacctgcctgagcggtcagcaggaaccaatgtggagactctgaggtctccacaccaccaaccatgtccaacctccagtcaagtgacaggaggagtggaagcattggttgggaagggcttggaggagctgcagtgacatgctcagccaagtacaggagcaggcatattggtgtcatgtgacctcatcttatctcagttatctcttttcaccaaactccaaggtgcaatgtgtggaggcatctgtctgtacccatggacaccttgggcttcacacattatttctatttctaatgaaccagtgttttgttaatgaattcatttcatcacatccttagtacttctaggttggaaaagcaatacatgtctctaagatattaggtaggaaatattctcccgccactcgtatttattaaagttaaaatgcttcagtatctaatgtgacagttgtccaaattcaatacccttcaccttgttagaaatggaatcctgatcctaacttgtctggagaggaggctggcatgaggagcatgaccacacatctggatgtccccagtgtcactgctaacacacgctcttttgttacttgccgtgaagggagcagagggagcatccacacctttgtccaaaggacttggaggacagtgcacctgattaaaaaatgcagggctgtgataagtgggttccgggtcctggatgagggaagagaagatgaggaggcatggggtaggaggcagggcagggaggagctgtaaggtcaggctctgagtatgggtgaaatcctgactccactcactactctctgggaggatttgataaatcttgtaacctcctgatgttggttctcccatcaataaactaaaggagaggtcgtgtcttaagcgtatgcttgctgtggggctactgtgaatgtgtggttgaggtggtgcctgcaaaacactctccaaagggcctggcacgtattaatgtctcaaaggagtcattctgcttaagctcgtggaggatgactttcctcctgtgtgcactagagggccttgttttgaggaccccagtgacttccctggtagggctcaagcacaaagggcatgactgatgcttcctctgaggccccttctattgggtaaaattcatgctccactcatgacacccacctggcccttcttctgaccttgagaaattgccaatatgaagccctcagactcagagctcagacagtacctcagacagacatgctgtaaagtggagagcagatttgcattcaaagctcctcccttcttgagcttcaagaagaggataagacaggagctcatagtgtccaggttccactgggcagtctcgaatagagctcttggaagtccctccaaccatggcctgggtctccttctacctactgcccttcattttctccacaggtcagaacatcccagggaattcagggaaatgttttcactgctattttcccatgagcaccagtcctcaggggcattctttccagttcttctgtgcattcagcatcattcatgacattctgtttacaggtctctgtgctctgcctgtgctgactcagcccccgtctgcatctgccttgctgggagcctcgatcaagctcacctgcaccctaagcagtgagcacagcacctacaccatcgaatggtatcaacagagaccagggaggtccccccagtatataatgaaggttaagagtgatggcagccacagcaagggggacgggatccccgatcgcttcatgggctccagttctggggctgaccgctacctcaccttctccaacctccagtctgacgatgaggctgagtatcactgtggagagagccacacgattgatggccaagtcggttgagccacagtgacacagatgaaggggaagtgaggccaaaacctcccacctcccctttctcctcagggactcagagtcaacagccctgggttcctctccagtaccctgagacctctgactctcctccctccaagacacccctaggcagaagcagatgcaggccatgactgaggccattttgaaaactcatctttctgtttcctccacaacagcctgtggggaccatgctgggagagaccagagcagcccaggcaggaaaaggaccttgagagagtggctaggatgagatgaccgtgtcccagtgtctcattgtgccctgtgctctattaccaggctctgccccaggaaaggacatggatcttgacctgtcagccatcatttatgagagttcaatttttacattttttaaaatataaaaactacaatctccaagatgctaggagcaatttcactgagtctcatcatggaattctgacctcccccagcatgtcccctgttcctacaatctcctgttcaagaccaactcaactccattacccagaccagctgctggatgatcaagacagggctgtgagagcctaagaatctttaaggtccacgatgagaacacgtcaagaaggatttatgttggaacttccttccccatggatattcacatcaacagagaagatatctgagttcttgcctacacctatgaatacctaagacatgaagtgtgtgtgtgcatatggtgtgggcagcacttcctcactcaacaccagagagtgtctgaggacactgggtacagacatggagacagggcatatttttatacactcaattaagccctcgtccttctctgctcaccaaggagccacccaacaaggccacagcaggaagagaagttgatttccatgaagagccttccctttctaagagtcctggaaacccactgtctagttgtggaatcagaggcagagctctggggcatctccaccatggcctggaccctcccctgctcaccctcccgactctctgcataggtgcttcctcccagggaataagccccatggaaccaggggtcagcctggccctgaccttgagctcagtgcagggagtgatgcagggtgtggggctatgggaatgagaccctaattctcagtctcacgtctcctgtctcctcttgcaggctgtgtggcctcctctgagctgactcagctgcctgcagtgtctgtggctttgggacgtacggccaggatcatctgccagggagatagcataggtgactctgatacaaactcgtaccagcagaagccaggtcaggtccctgtgctggtaatttatggtgacagcaaccagccctcagtgattcctgagcaattttctgactgcatatcagaggacatggccaccttgattattaatggggcacaggatggaaacaaggctattactgtcgctcggaacagcactgcttctcatctcacagtgacacagcatacagtgaagtgagatgcaaaccccttcccatctatgtcattctctcccttcaaccccaagaggactgtggtcacagccatcagcaggtctggcccagttcattcagatttgagacccccaggctgcccttccctccagtcctccaggcaggttcattagatggtaaatcaggggtggatacacaactattaaatatcatcatgttccaatttttcatgaagtagaggaatgattgaacatgttaagtagaagcacagaataaccaaaaaaggactaattgagcttgtgtacagctaataattgcaatgtctgtcaactttaaaaacatactggatgtgattaacaacagattagattatgtaaaacaaaagattagcaaacttgatcatgtagcactagaaaatattcaaaatgcagcacataaagaaaaaacaatgacaaaaatgaaaaagcattatcggatattcataaagaaaatgaaggtgagttataggacaacttcaaacagcctgaggttgactaggagtaatggttcacgcctataatcccagcactttgggaggtctaggagggaggatcttttaagactaggaattcaagaccagactaggcaacatagctctataatttaaaaaaaaaaaaaaaacttaaaaattaactgggcttcgtggcttgcacctgtagtcgtacctacttataaacctgaggcagtaagattggtagagcccagaaattcaagactgcagtgagtgagctatgatcatgccactggactgcagcctgggcaacagagcaagttcctgtctctaatatagggtctcaatctgtcattcaggctggagtgcagtggtgcaatcatggatcactgcagcactgacttcccaggcccaagtgatcctcccagctcagcctcccaagtagctgcgaatactggcgtgcaccaccatgcccagctaatttttgttttttctggagagactgggtctccttatgttacctaggcttgtctcgaactcctggactcaagcaatcctccagcctcagcctcccaaagtgttgagattacaggggtgagccgctgcacctggcctaaaaaaaaattttttttaatacaacaacctaagtatgtataattgacatccatggaatgtaaaaggtatgggtgggtagaaaagaatatttgaataaataatagtcaaatgtgctccacatttggtaaaaaccaaaaactggtatatccaagaagttcaacaaaactgaagcacaggaatcatgaagcaaatgactccaaatgacataatagtcaaattagtaaaatctggtgatgaagagccacttaaaagtatgattctaagagtacatttctcattagaagcaatgtaagcaagaagacagtggagcaataattttaaaatactgaaagaaaacagctgtcaaccttaaattctttatccaacaataataactttcaaaagtggaggataaatataatgttttcagacatataaaaacttacagaattgattactatcactcttgtcattagaaatgacaaaagacacccctagacagggggaaaatcataccaaattgaaatatgaattcacacaaatatcagataatgcaactccatttgaatatataatcacatttgaagacagattttaataagtgatatatgtatcacaaagcctaaagtaaacattaaacttttttataaaagaattatgactagtaagctgtattaggattctccacagaaacaacataaatcagatatgcatgtatgttatacgtgtgtgtatatatatacatatgtgtatagtatatatatgtgtgtatatatatacatgtgtatagtatacatatgtgtgtatatatacatgtgtatagtatacatatgtgtgtatatatacatatgtgtatagtatatatatgtgtgtatatatacatatgtgtatagtatatatatgtgtgtatatatacatatgtgtatagtatatatatgtgtgtatatatacatatgtgtatagtatatatatgtgtgtatatggtgagagaaaaagaacaagagagaaactaattttgaggaattggatcatatatttgtggtagctgacaaggatgaaatatgttggtcaggctgaaggctggaaattcaagtaagagttgatgttgcagtcctgcatccaaatttagcaaggcagcacttcaggaaacctccacatttgttctaaaaacattcagctcactaaagagtcccacccacattgtgaagagaaatctgcttatacaaagtttactaattaaaatgttcatcacatctgaaagttatcttcatgtcaactcctatactggtatttgataaaatcaatctggtgcatagcctacccaatctaacacttaaaattaactatcacttaacccagcaaggaaataaaaagataatttaaaaaatcaatcaaaaaaggagacagcaaaagggaaagaaaactaacgaacatatgggacaaatataaaataaagagcaagaagatccttccagctcagcctactgagtttctgggactacaggaaggtttgtagttctccttgaagaggtccttcacatcccttgtaagttagattcctaggtattttattctctttgaagcagttgtgaatgagagttcactcatgatttggctctttgtctgtctgttgttggtgtataagaatgcttgtgatttttgtacattgatgttgtatcctgagattttgctgaagttgcttatcagcttaaggagattttgggctgagacaatggggttttctagatatacaatcatgttgtctgcaaacagggacaatttgacttcctctttttctaactgaataccctttatttctttctcctgcctgattgccctggccagaacttccaacactatattgaataggagtggtgagagagggcatccctgtcttgtgtcagttttcaaagggaatgcttccagtttttgcccattcagtatgatattggctgtgggtttgtcgtagatagctcttattattttgagatacgtcccatcaatacctaatttattgagagtttttagcatgaagtgttgttgaattttgtcaaaggccttttctgcatctattgcgataatcatgtggtttttgtctttggttctgtttatatgctggccacttctcaaaagaagacatttatgcagccaaaaaacacatgaaaaaatgctcaccatcactggccatcagagaaatgcaaatcaaagccacaatgagataccatctcacaccagttagaatggcgatcattaaaaagtcaggaaacaacaggtgctggacaggatgtggagaaataggaacacttttacactgttggtgggactgtaaactagttcaaccattgtggaagtcagtgtggcgattcctcagggatctagaactaaaaataccatttgacccagccatcccattactgggtatatacccaaacgactataaatcatgctgctgtaaagacacatgcacatgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggaggggcgagggatagcattgggagatatatctaatgctagatgacgagttagtgggtgcagcgcaccagcatggcacatgtatacatatgtaactaacctgcacattgtgcacatgtaccctaaaacttaaagtataataataataaattaaaaaaaaaaaagaaaagaaaatgtctctagacagcttggttcctgagctgggaatcaaccgtcttttctctccctttcaacccagagtgtggcaggcgcgccccctacaggcagctaaaagagctgactgagatgccgtctccatagggagggatttgggctgagaatttgggctgaggattttcccatgccctccctggcaggctggtcccaggacactcagaagacttactgttacaggtccagagcatttctcgtcttccttttctctctccttgccaagtgaccttggaattgttcctccccatctcagccccttcccttttgtgttaagtgcagtttgcagattttgtgttcctaggtcctgtatctgtagaattttagggaaagcagtgctggtcacccacatggaattcaagacagcgagcccaggaccagaaacacagacagcagtgggggtccccacagagcagcatggtgggcaccaggtggaggtaagaaaccaggaaccactcccctgagtgtcttcagccccaggtgaactagggaggggtcagtgggctgggctcaacccaccggggactctcctgtcactgccccagcagcaccatcctggaagcccctatatgtgctaagcagctgccaaagaacttgattaattacctgtaaatttcccttcaccacacctgaccacacatgactcctgcccccaaattactaatttattaaaatggcacaattagccgaaatggcctgaatccaggacccctttcaggtttgccgctgacctctcaggtcctcacacatgccagactctttccacaggggcctgactccactgtttccaacacaaatcccaggactcatttttctctgtcagtcctgacagcagttccagagacacttccccattaagatgtccccaggctcttataatacaacctgtctgttattttctgcctaaatctttttaattatccccatagcatttacaactgtaggaatctttgcctattgttaattttattaattgattggtgttaaatatttacttaattggtcatggatgcttttttaccacagaatcacacataaaaaacagacacaaacagctaagggtgtatttctcgctgcaataatacccaccactttcacgaagacaccagggtctttctcactttttgtcccaccatccctatgatattggctttattttcatccctgctgatgtgtgacctcagggtggctgctgcagctccagctatcactcccatattcaaggagaaaagggcctcatgaatctagtgctctttcacaagagcaaagctttcctaagaagaatttcacccactgatctcacaccccactgatcaggcctgagtcacatggtcaatcccagctgagcaggacctgggaatcacaggcaccagtcttttcggtgaatatagaagacagtgctcaggtggaaggtgacagggactgtctgctgggtctgcaaacccagttttcccgcacagccaaaccagcacgatgaacaactcacttcaagaaggctgtgtcttgttcctgctgaattcaccgcatggaacgtgtcccagaccacagtgggtctggattaacatttgatgggtggatgttcttctgtctctgactttggtgcaggagtcaccactgtacgctggtcctgcatccacagcggggaccagtaagagccagtccctgagtcctgtgatccccgccctgcatgccaagccctggtattacccccatgaccacccaccgcccagacacatgtgcaggcagcctcagatggaccttcctcctcctcttccaaatattcatgttcatattgtcatgagtaatctgcacccctcgcacctggtattgaggcaggcatgagtcacaaagagaagagaaaaatttcctccattggcaccagcagtctgcagaccagggaatcagggacctgaacagaagattttaattatacacccggacccaggaggcccttgagcctccagcagccagtatggagcagccaccaggggacagaacagagtcacctggcaaagtcacttggagatagggtagacctgggtgacaaggagatgctgacatgcagggagggtcagtgaccacaacctgagatctagaaaggtgtcgtttttctacagcatcatccttaacatcgagtacaaattctccaggctttgtgtttctcagctttgtctctggccaatgttgcatatttgacacaggtgcagacactttgcttccccctacacactggcccactcttctgtgctaaaacgctgtcattgccacaaacgccatcctcccctgtgggcacatgtgtttcatcaccctcctgtttgctctgagagccccctcattctgctacacagcaaagttttctttcagcatctaagctgtacctgaccatgaccacatactgggggtacataggcacagcacctgtgccctaccctaggagctcacagccaaggccaggaacttacagcatctcctgagtctttcaacactccgtgtgcacatgacaagggtgaagtttgattgtggaaagcaccactcagaagcaatggcaggtccctgcatgtgtgccagccttacggtgtcacctgtagagtggggtcatgagggtcactgcactgggttgaaaagtgccctccagagggggagctagaaccacacctaacttctggattttgccacaaaatatttagggacaggacacccctggagtcctcaattacccaagttattctgagccagtattcaacagaggaagtaccttagatctcagaataatccctcagtcgccattgtaagtcagtccctggccatctccacgcaggacaaggaatggccacatgggcaggacatcatactacctggaaaacgcacaaagaattcctctcagagttctgcatggccagatcagctcaggagtgaggccataacacaacctacagtgacgatgtcaacccagatgatgggaccagaaggagaatgagaattctgtgtgctgagggtgggtctttaggggccccctctctctctgtcccttggggctgagcccttctctggaaaccacacagctcctcctgcagcagcccctgactgctgatttgcatcacgggccgctctttccagcaaggggataagagaggcctggaagaacctgcccagcctgggcctcaggaagcagcatcggaggtgcctcagccatggcatggatccctctcttcctcggcgtccttgcttactgcacaggtgctgcccctagggtcctagccactggtccagtcccagggctctgggtccagcctggccctgactctgagctcagcagggcccccgcctgtggtgggcaggatgctcatgaccctgctgcaggtggatgggctcggcggggctgaaatccccccacacagtgctcatgtgctcacactgccttagggctctttcatccctggatctgtgtccaggccaggcacgtgggaagatttacttggagttcagctcctcagtttcaagccttttctctcccgttttctctcctgtaggatccgtggcctcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactgcacacagtgacacaggcagatgcggaagtgagacagaaaccagccacctcggcctggctcacaagacccttccctctctcctgccctgtcacactgagcaggagggagccttccatgtggaatggaagtttccagtcctatccctgcccttatgttcctgagagacgggagcaagttcctgcccacctctaggctcagcttatcccagaataaactgagctagtcattttgatgatcaaatgccagctcccaaaagaccccagaaaccctgatatctaagtagcaccgactctattagtatcaagggagactagccctagggtggaatcattttagtgtctcagaaggcacagggcaatggaaagtgtttatgaggtttcaggatatgcacgtgagcagttaaaggcaggtcttacaaggaaggaacctactagaattggggcccatctgtgacatcatagcacagcctggtggacacagagaagggaaggtcctgaatcaagtcttgatcagtaaatatttattggataagtgagcaatttacataggtgagaactgtgtgctctcttgagcagaacacttacctggataattggttttcaggaattccctgaagcaatgagtgacattctttattgttttcaccctcatccacctgggaaagagtatcctggaaccagcagttaacattgacacagctggtctcggtcctcagcacaaacattcattgcaggctgaaaagtgacaacggaagagaaaggagtttattaaatccctagacacaaacaaatccataagcagagatgagagatgcgggctcagctggcccagtcccacaggggtcattcctcttgtgatggaaatgaccacatgagggtcccccaagcggtgttggggggcagtcatggggaactggcctcccagggctacctgctgcttgggctgggcagaggttagagggatggaagtctggtccagtccttcccagcagcatctccaggctcctcctccctctactggggcttcccctccactccccagaaccatcattgcttcctcatctcctgtctcctccctgccccaaggccctccctgtgctcaccctggctcctccccctgctccatgcccagcctctgcagagcagcccaggcccagagacttgggcagaagcttccgtcccaccagctgcagaaccttccctacagaaccaggccagtccctgtgtctcatatttgtagagatcccaatcaccctcagagatgacgggtgggaaaccagcccacagtgacctaggctgttgggcatatggccttcaagctggccttcaagcccacttggctgcatctccttggccaactccaacatccaggctgggagtctggaatcctagttcccctggcccattcactcccactagggttgcttctaaactccctgggcctcagcttcctagtctgcccactggaagcagcgacaggcattttccagggctgcggtaagggccctggaacaccctctctcaccctctctctccctttctctctctctctctctctctctctctctccccctccccctccccctccctctccctctctctctctgcctctgtttcctcctcagtagtgggaagaccccctgtcaggtgggccagtccatgacatctacagagggagcaggaacctctcctatttcctggaggagagctggggtggaggctgcaacccaggatcatcagaggagctggggtcttcaaggttcctagggaccccttaagcgggggtcagagtggcttcagcggtcttattgctcggtccagacagaagatgtttccagttgtgaaaaacgacttcagggacaacaaaaacagagattcgcctctccagacaccagtggttggtgtgcctggagtactcctcgtaccaggcaggggagagagtcctagacagaggaggttctaagtgtcacctagatttcaggcctcggggcctgtattgggtaggtgatgtcacagtgagttgatgctctgtagccccttccctaggaggtggcagagggaagagctggtggtcctctgaggtgtgagtgagtccaaccctgagggtcttcccaagctggaggtccctgggtgtagacggaagaggttctggtcaaagaggcctggtgttgaatcctggtccatttattcatttggtcaagaaatattcatggaggacccaatatgtgccaggtgccaagccaggtgactggggacacagtgttgagtgggacagttggctccttcactgctagaggtattatattctcaagccgagactcggctctacgattgtatgtcagatatatagcctctatgtgcatgtctccagagactggtttcctggagttccaagtgacagccatcactcacctcgaatgcaaaaattaaaggagcatccaaaaacctagtgacccagataaataatacttaatgcaatattttcaaaaatcaaaattaatgcccaacaaacccacaatgaacaaaatttcaggatctgactcactcacctcagtggttttgttcttggtcctacccacagtcccacaggtgagtgagtacccacagggatgcaaaaccagagtcaggcccctgcaccgccttctgcccggccaccagagccctcccctgggtcttggcctttctcttctgaagagctccagccagttcctcctcaggcttcctctactgctggtctcttctgccccctactggattctccccttacagctgcactccaggcagctggtggaggttaaagaacagaaacctcccaaaactccaccctccagttccaggctggctccacctcatgtccaaaaaggctggtcctccaggtctttgattgctattagtaagtcccaagacacagtctttacaccaagtcgctgtgtgccttgggcaagaaactctccctctctgagactgtgtttccacactggtagaagtagctagaagacctccctgccaggttggcaagtccactctgtgacatctacaaagggagcagggatctcttccatttcctggaggagagctggggtggaggctgcaacccaggatcaccagaggagctggggtctttggggttcctgaggactcctcagagggggatcaggagctgcagagccagcttctaactctggggactcagagatccagaacctttgtcatatccccagccaatactttgtcatcctgtgcctcagactcccccagatcccaagagtgagaagctcaagacgagacaagaaagaccagccagcttgaatttagggatggtggggagtggggagctggggacccctggacctgggggagaggagtctgcagtgcctgcaggtggagtttctgggacctgggggatggagactgggcaggggactgaccagcagaaggccaaggtgggggataccctcagacatggagcagggcagaagcaactggatggggtacatccctctgctttgggagagaagggccagggcgggacccagagagctctgcagaggcaccacagaccctcagcagggggtctgccaaacaggacagctggacttggctgcttctgcccaggcctggatccagcccttgcacatctcagggcaggggataggcctgggtggccagagctgcagctgcacctgctggggaggcctagtccagtcctccagggtccccagacagactcggatttccgactgcagccaccatggaaggatgtggtctgcggtgacgatgtctatccagaggccatggcaggtgcaagggtgggggtaggggcagcagctggggatgctacatttagggacagcccctttttatccccaagacctgggactgtccctgaaaggaaccacagcttctgggtcctgagcagtgggtgagtgtcatacccacagaggggctggaagggagcagcttcagcctagactcccagggcagaccctgccccagccccgaatatccaaggagcccaagatcagaggcaggaataggccaagctccccagtggagaagctgtgctggaccaggggtttcccagggccctcccttgtgccctgaatgatgtctgttagggcacctacaccctgttactgctcagtgccttgcctattttgaaggacagggatgtgtggtgattatttgtataatccagcccccagcacctggtcctcaaaagttacccaagcaatgtgtataaagatccagcctggagatctttgaaaaccgattcgatgagtcgaaccattaagtcatgatcaccatcctcaacttcatctctttcttcctcctcctcctcattatcatcaccttcaagaactgttaagagtctgagacttcatcctatttgcagactaaaaagtaagcctgccacagtgccatggatgctggcagaagatacaagactcctgggtcagagacaacgaataatctgtttttcacagcaatagcagttgccaaggtatcagcattgtcttgcaccagttccacaaggtgatgcaaagagggccaggtgacatctgcatgccagagctcagggatcccaaatatttcatacttgacagtaagcatatatctgtgttttgctccaaagagaggcattctctgtaccttccgaggttgttcactccacaaacactcttgaaaagataatccacaatcagtgcctttgcccgagagacatgcagaaatgcagagatccatagtagaccactgtctcccaacaaccatcaactttatcaatgaaatgaagtctcaggctatttgtctgttaccatagcccacaaaaatgtctggcttgattgtcaccaaatgtatcaaggaagttaaggagtatctgacacaaaatgtgaaccaagcaattctcaaaggagcctcccaggaaattcactttaggaagtcctaggaggctcctctgagagttgctaaaacaaaacattgagagtcctagagggctgcagatctgaacttgagcagatatttttaaagattttgtggcagaaaaagaaactggaaagcaagagggcagaccctcattgcagttctgtaatgtaagggggcagagcaggggcctttctcaccagagtatggggtcctgaagatctcctcaaacatttttatactaggctctcagggcaacagaaaagatgggagcgatgaatggggcgtaaaggagtgcaaatgacacaaggggtcacatgaagcaaaagaggtttattcaaccagatttagtccatgtttaattgagccactcctttgtgccaagctctgggttttcccatgcaccaagcagtgtgttaccacctagacccagagagccatgtcatcatcagcaaagcacgccctagtgtcatgcaaggaccaggcctcagattccgactccagacctactgcctcttggccctgtgacattaaaagagtagggaatcagcctgagcagcatttcctcatcttcaaatgtggaggacagtagatgatcttagctcccaggattagtgcttgtaaagcaataataatgtaatgcattattattgtattatgcatcatattcccatattatagtcaaaaaggaccccaacttaaagcacctgccagccctctcctcctccaccactgccgaatggagccaggcacgagtattccaggtggacagacgaatagaaatacaggggacgagccccttcctagatcctagcgcagcttgctccctacttaaggaatgatattggaccctgcattcatcttctctggatggtaattttctcacctgtaaaacagagacactggccccaaggacaccccacaagtagttgtgaatcccaaagtaagagaagaacaaaaaaagaaccagaatttattcaacacccactgagtgcttagcaaacacatggtttctttaactctcataagcttcatgctgcagaggaactctccccattttacagataaggaaactgaggcccagaggtaacctaggtctagatagactccacatttatgacttcaccactcttccttgcctgaaggatatagaatcactccctgcagggctcttgcctgactcaggaaagggccacaggatagccagccaggcttaaccaacccagccaagaaagggctggtcccaactggctggagtgcagtgtacaggcacccagcctggaagactgatcagaaaagaagccacagctccagccccagccccaaccccctgagctcaagcccttggggactcctgctgggcagctctctaggccctagggagatgctccacagacccaggctgccctttgggaagtggggaagacaagtgggtcaggtgtgcaccacccaggggcggggccaggcagccggctgtggtgggaggcagttgagccctggattgtgaccgcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtaaggggcaagagattccaggggatgtgggggtcctgcagcagagctgggaaagggtgaccaaggggagacaagccagaggagtgaggaggaaggttaacccctaagaggggcctgggctgacactggctttagtaatgggttgatattttgtccatcacagatttgtttgaattactgtttttaatatcatattacgatattatttttcttgatttctgagttttctggcgccacttaaattttcaccagggtcagtgcctcaatcacctagtcctagtcctctgggtagggaaggaacagaggcagggacaggacatccacagggggtggtggccactgtccccacagggtgcccaggcctgttcctccccctcctcctctctgcccatgtgcctcctgcccagtgagggcaggggccactccctggagaaggcagcaagggcttggtttggtctcccccaaggctgtctgttcaccaacttgcacataaatgcttactggggccaggctcaaggacacagggagggtgggatgaaccgaggggagctgtccagtcattggaacaggcccacggcccatgtttggagcaataaagggagaggggatctccctctgggatgatgcccaggctggtctcacagatcgaggggcactggctggtgatgggtgcccccaaaagacagagcagcgtcagaggagaggagagcacaggatgaggctgggagctcctgggtgactgggaaggggaggcaagaagaccatagggtccgtgcaccattcccagtccaggacgagtccttggatggatttaggtagattgattatcagagtcagatttgtgtttttggaaaaatcagcaccggattggaggctgatgcgacgcccgattagaggagggaggagagggggtgatggccaagtccagggtaggtggggatcctggaggaagccgtgccttggggatggggaggacactcagattcagagcacccaggggcccagtttcctatgaaatgggagcatgaagttgaagtgagggctgagcagaggggagcagacacgctcggggactgtctatgggcattaaaaatgtataaccattttagcaacaggcggcgagtcaaaaaacaaagtgtgtttatctaaactgggcaattccacttctaggaatttatcctaagggttggttgggggaataatcaaagctgtaaccaaatctttataacaagggtggttagctcagcattattagtgatgggagaaaactggaaaaaatccaaatatctaccagaaagggtgtgaaaaaacacaattgtatttgggggactgttgttgtttttgttttgaaacagtcttgatctgttgctcaggctggagtacagtggcgtggccacagctcactgcagcctcaacctccagggctcaaaagatcctccagcctcagcctcctgagtagctaggactacagatgcaggccactacacctggctaattttgattaggattattattagtttagagacagagcctcgctatattgctcaggcctgtctcaaattcctaagctcaagcaatctttctgcctcagtttcccacgtgctggaattacaggcgtgagccactgcacctgacccaactgtgtttttaaagtatatatgcattttcaaaaacctgtcagaaaatatagaaaaatgtcaatggtgtgtctggctggctgatgggatttcacctaattttaatgtggctttataattttctggttttgtgaagttgttcacaaaaagagacatttcttctaatataatttttaatacaacagtaatgtactcatgtgcattactctttttgtaatgagtatattacaaaatgtaatgacttttgtacattactcttttttcttgccaaaaaaaaaaaagattaagcagagaagtatataaagtaaaagcaagtgcttctgcttaccatctctcacctcttcccagagatagccactgtcaggttggtcaatatacttccagaacttttcctgtgtgtgtgtgtgtccctgaaaacacacacacacacacacacacacacacacacagttggtgctgggattttattttgcaaaagtaagagccatattctgcatattaccaacttttaatctattattgacactttctgtatcagtccatatggattaaccacattcattgcttataaactttgttttataagcaaagtttagatgagccagaatttatttccactaaaaaatctaaatgacaaatgatgctgcagtggaaatttgtgtgtgtgtgtgtgtgtgtgtgtgtgtgtgtgtgtgtgtgtgtgtatgtgtacaaagtgcacttatatatctccccaggatagatgcctaaaagtggaattgctggatcagagagaatgtacttttgaaatcttataggtagtgtttccaaaagtctgtgtccactcactccggtgaatggtagtgccttcgctcctacattcttaccaataatgcaaaattgttgatctttttatattctgcccatctgatgagcaaaaaattgaatgtgtttatggttttattgtgtattttattactggtgaaattattttttatatttttatttattggttttatttcgtctgtgaattaactggtcatcatgttgcccgcctttccattcagttgctttcatctttttatatatcaataacatattgggatatatttgggattttaaccacttgtttagtgtatgtattgtaaatatttttccctggtctgttttacgggtcttttgtttatggggtctcccaccataaaactgtggtaaatttttatgtgtcgaactggtttaatcttttctttatggtttctgtgacctccaccatgtgtaggaagttgtctttatttcaatattataaactcatttttctgttttattctggtacttttggtgtattggtgttttatttttttttctttacttcccctggagtttatttttgtggatgtaggaataagaccttattttccaaataggaaagccaatcatcacacatttgttgaatataaatgcaacttttctcaattactacattactgatttattacattctttctgtggttctcttggtttattgagctattcctgcgcccaccctgttttgattattttagctttatggtatgttcggtaactggtagggaaagaacccgtcattgttactttttctcaaaatagtcatgtctattatctgtcattcttagagttggactgcagaattggttctctaattttcaaaaatcattcttgtgttatgtggtaatatcacagaatatgggattaatttgagaactgctatctttataatgctcagtgtttttgttcagagacatgatgtactctccattcactcagataagtggtttaatattttattcatgcaaatcttgcacactttgttttttattcataaagggtttgtaaatataattttattgaagttataaattttttcacaattttatatcgtaaatgattactgtttctatagcaaggaaccctattaacttttctatgttgctcttgtatccagacactttaactcttgtattaattccagcagttcttcagctgattctccgtgtgtgtgtgtgtgtttgtgtgtttagttaactatcacaccatttgccaagaacaattttctctctttttctgtaatatttatacctccttctctcccccttttatgtcatttcattggctggaatctatacaatatgctgaataataaaagtgagactagacaaccttgccttgtttctgattctttaaatgttttgcctttaaatatgaaggttgctgtaaatttggggagatattcttcactgagttaagaaaattttcttcagtaacttaataaaaggctaaatgtttgctttctttatatgagaaacaagtgttgaatttatattactattatattaaattctgtttcaaaaatcttctgcacatgtcttaaatacaaatgtattaaatacaagctgctgctaagatgaaagttgctggccccatcacaatgggtatcttccaatgtgaataaattgccttggggaataaaatcagatttggaaaaacctgaggatggttgccatcataaactcttagagtgtgacctgggtgtttttctttttctctgtaggatgttaatagtatcttgtgtcatgctaggatgtctaggacagagggcaatacaatgaggggaaggcattctgcgatgtccccaggcctctggcttgaagagtaacttgctgaagtgaggactctgtggaggagcaagttatacagaaagaagtttagttgtgatctgttgagttggaggtgtctacagggcatccaagcagacataggttgaggaggcagaatatatgtgaatctggagccaagaagagaggtaagggctggaaatagggatctaagacccctggacagttgtgagtgtgcacaatgagggtcagatgcagagaaaattaggagactacagagagcagaacccagggtggggatctgggagtcagcagttgggcatgggcctggtagaaagggaagccaaggaggaggagagggggcagtctcagacaccaaggaggggagagtgactagaaagaaaaccttcttgcagagacataggggatggggaagaactgcagactgaactggggcaaaggactgttggccttaaccagagagatttgagggagagatgaggctgagagccaggggatcctgccatgtcccagcataaaaacagtacctgacacagatgggtgcttgggagctgttgtcggatgaatgagtggacagatgcatggatggacggatggatggaaggatgatagattgatggacaaacagatgaacagatgaatagctggatggacaactggatggatgggtagacagaatgatctcagagatcagaaaaagcttcatgcactaagtgggactgaaccgcgtctccatgggtagaaagcagaggaatctccacttgagtcaggaatgacccagtgctctcaatccagggagaaagccagcctggcttcactggggacacttgtgtgggggactcagaggccctttaaatgaggccagacgaggttggacaggtccaagccaactcagcactcctctgccacactgcacaggaggggatgtgtcactcagggagttgctgggacctatgggtcccagtgttgtcatcagcaccgacagcctcagagaggaaagacacacactggggtaactccaaggctgtgtgtggcacttgccttggacagcagacaggcacagggacacctctagggggctggccacccccctgcctcatgtctaggtcccagccccgcccactgcaaccctgtgcccgtcatgcccagcaggctcctgctccagcccagcccccagagagcagaccccaggtgctggccccgggggttttggtctgagcctcagtcactgtgttatgtcttcggaactgggaccaaggtcaccgtcctaggtaagtggctctcaacctttcccagcctgtctcaccctctgctgtccctggaaaatctgttttctctctctggggcttcctcccctctgtcctcccagccttaagcactgacccttacctttctccatggggcctggaggaggtgcattagtctccgggtaaccggcaggaagggcctccacagtgggagcagccggatgcagcctggtcccggggcctgagctgggattgggcagggtcagggctcctcctctcttccagggcagatgtctgagtgagggacagaggctggttctgatgaggggccctgcagtgtccttagggacattgcccagtgactcctggggtcaaggacagaggctgctggggtgggcctgggagctgctgagtctcatagtctaggggagcagccccaagaacagctgagggtctaggctgaggactggatgccaatccagcctgggagggccacacggcctggtgacacagaggtcaccccaaggggagaccaatggagggcacagagagggctctgggtctaggctgcagctctgtggcctgtgctgggtcatgaggacatggggacacagagggacgggtgagactgggtgaggtgccagaatccaaccctcccaggacagtcaccagaaaggagacagtctcttagggcagagatgtgtctgtccctggagccccgtcacctctggggcccagtgtctctctgttcacggatcggcctcctgccttcctcaaagggcatgttagactcaggaaatgaccagaggggagtgaatgaggggtgcagagaactccatggctaccaggtgaagtttggggtcatcacaggctgctggggtgggcctgggggctgctgagtctcatagtctgtgggagcagccccaggaacagctgaggtgaagggttctgtggtcgggcttgtggagacaggaaacatctcagagcctcagaggagccctgaggcttgtctaggtggagcccactccttgccaggagagccaagtgggctgggctggggcagagcccggtgcctgtgagggataggaagctccagttcaaagcaggcttgggtctccccacacactgcctgccaggacagtcctacaggatgagcaggggacccacagttcacggaggaggctctaggtcctggaagaataaagtgggtgatggaggggggtatagggatggaaatgagggatccaggggtcaaggccagattctaaactcagactccagagatcagagaagaaggaacacagcctgccctgggtatatggagaaattgaggctgtagaggagaggggctgggccaggacacctgtgaaaggtgacttgggagggctcctaggaaggcacagagctgtctgctctccacagggcatgagtggaaaggatggggaaagaagaggagagaaccccgggtggaccggatggccacactgtgaaccctcccagagactttagacagagagaggggctccacaacaccccggtattctgtctgccctctctcacccccttccctgtccacacaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttcataggttcccaactctaaccccacccacgggagcctggagctgcaggatcccaggggaggggtctctctccccatcccaagtcatccagcccttctccctgcactcatgaaaccccaataaatatcctcattgacaaccagaaatcttgttttatctcattttttttctcacataaattgctagcctccccggggttctcagtgtggggtacagggaattctgcacccagtgtgaaaatcacccaagggaggaggctcacagcctccctgagtcatctccccagagggtccttcctctcccagtcaccccttctccaactctccactgtacccctgagctaccagtctggcatcagttcagaccagtcccacaccctcctaaattttacttctcaataaatacctgatcatgtaaaacgcagcatttctaatgtgcagtctctgtctggtcatgtgtctgggctgaagggtcactgctcagggacagggggcagttccaggtgagatcccatgtctccgtcatcccacaccccacccaacctgccagggaaccgggtgagctccctgtgccagtgggaactgcaatccaaggcacaaaattgtcctgcagtccttgcccacctgggaagggacaggggcccagtgagaggtttgctggcgccctgtggggagattcaggagaaatgaagggggtccccggagaccagatgagggctagaggcagaaataatggaaaaaggacacccttgactcaaggccacggtctcagcaggaacagaaggtgaaattccccattgcatacgaggaaccagtcaggagagtgtttactgggtgagggataaataactgtgctgccactgggaacttgtaaaaacattgggaaaggaaacatgcaagtgtctttctaagacttgtacaatggacattggctaagtaaacatactgacaagtcctgcactagggaaccagtttaatatgatgagccacagcatatccaaaagcatgttgatctccttcttcacctttagaagacccaaaacactctgaaagataccagcgtttcctggaactagtttgtggaatatggggtgaggttgatgcacatgatgttacgggtatatgatcacatggctgtgggttggggatcaggctcaaagttaacactagcgtggggctggatgtcaagcatgaagggtgtggaccactaagtcaggcccaggtagagttaatttctgattggtttgtggctggagcttgatgatggtcagtctgcaggagcaggaggatgtggggaaattgggaaaatgagaaaagtcacaaatccaagctcaaactctgcatctattgattgcctgggggaggctaatcagagttgaattcaggatgagcttcagggctgggtcagactgaataagagctgagtgaatgtgggctgatggctccaggcaagtcctggcctccactaggagtcagatcccacaaaccctcctgcccgcagagcaccctctccctccgtagctcatggtggcgcagcctccccaccccatcccatgtacacctgctgcctcatctcagagacactcattccagtgtctctgacagcagatgatgtcagcctcctgggtgtggagaccccagctgtcttggagagtcctcagtgcctgggtactctcagaccccctgtctctgcctccagcacatcagagacatagcagctgcctccaccagagctgctgggtgatcccaacaggccagggacagagcctgcaaagacaggaatctctgcagtcacaatgaggcaaagaaagagccccttagagcttgatcacagccacccctgatccaaatcccagcctctcattagaaggaggcttgagggttctgttgccacagcacctgtctgagcccatttcatggaggggaaaactgagatgaccaagggccagatccatagtcctgctgggcacaaggccatccccagcagctgcctaatctttgactgtgttataagtttccattatggaaaactttgaacacatacataaggagacagagaaataataatgcccccaagttcccatcacccagcccccccaataagcaattcacagacattactgacccacccatagcagaataacccctccattacacaataccagacatcacatcttttcagctgtaaatatcccatttctatgctggaaagatatgggcttaaaagtaactgcaatattattaccaaacctaaatagaaattatcactaattccctaatatcaagaaataatcatgggctcctcaaatccctcacaaatgccagaagcgtattgacttagttaagtgttggtgctgtggttattttggggttttgggtggtttatttcagaattcaatatggcatcaaatggtgatgggcgcatgtgctgtcaggccagttgtcactggtgaatatttcctcaattgctctagtgctgcctggcaaggcaggagctgcaggagttgagagctgtccggggaccttcccacggttggaatacagccacacctcccaaaacaagaacccagggctatcatctacttctttttttttccccctgcaaaatggttctagcatggagggacttaactggattcagactagacattgcaaaatagcttccaaggacagggagctgctaacagcgagatcacccatgtcagattctcactcttgtagtaatgttagctgcataggatggtcaatagctacatccctcagaagggaaggaaggcagagggatgaggcttcagttcacctccttctcatgagtgctgcagagcatctgtgaattcagaggtctgcagctgggctctgttcacccaggagtgtgcttcatgctctaggaaggagccactttgcacacagatgatccggggcccagccatccttccagggtgaataattaatgtcttctctcatggtgaactctaggattcaagccatctaatgtttttgaagccactgtcattatatttaattgatgatgacaggtggccaccaatgatgaatattttcccagggggagtctccctaagtggctttagacttcctcacatggccccaggggattaaatggctcctgattactcagaggataagaggttctgtcttatcatgttcctttcttatttgtcttatgtgtctttcctgccccaggcctgggatcccccactgatctcccttcccttagtgagaggtggtatttggagaccacattctggaggctcccttatgtcccccatttgaaaaagacaacggcagccaccaccccagctgtcccacccaacatgaggccagattcggggtgcagggatgctcccaaggttaccctaacagatgtgactggcacttcatattgggaccagccaggcctcactgaccaggcctatccaactagaactactccagaaggtggggctgaaacccaccaaggttcccagaacactgcactctagggcaatcagcctctgcatgggaggagaggggcaccctctgcaccaccccatggtgttaccaaaagttgaaccatgggttggttcaactttgcagagaagagaccacctaacccatctgtggaaattcactccttagcgatactgatgctccctaagaaattcaatcctgggcctgagtgatggttggtgcaaaaaacaaattcaagatcccagtgtcctccagaagcctggatttccagggatcctgctgtgagtcacaggacgtcaccggtccccttctctttgtgggttgagtgtgggggccatgtggactccctcatgagcagatgccaccagggccactggccccagcttcctccttcacagctgcagtgggggctggggctggggcatcccagggagggtttttgtatgagcctgtgtcacagtgtgtggtattcggcggagggaccaagctgaccgtcctaggtgagtctcttctcccctctccttccccgctcttgggacaatttctgctgtttttgtttgtttctgtatcttgtctcaacttgtggtcagcctttctccctgcatcccaggcctgagcaaggacctctgccctccctgttcagacccttgcttgcctcagcaggtcactacaaccacttcacctctgaccacaggggcaggggactagatagaatgacctactgagcctcgtctgtctgtctgtctgtctgtctctctgtttgtctctctgtctctctgtttgtctctctgactgtctgacaggcgcaggctgggtctctaagccttgttctgttctggcctcctcagtctgggttcttgtcggaacagctttgtccttgggttacctgggttccatctcctggggaattgggaacaaggggtctgagggaggcacctcctgggagactttagaaggacccagtgccctcggggctgatgctcgggaatcacagagctgggacccagagccaggatccagacccagaatgaggtaggaggtggaggggctgccctgggcgtctgggggctgccagggactgagccctgagccagcctgagactcaggaaaccccgtcaggagggagaagggagaagcagactctggacaccagaaagccaggggaagggtcacaaaaggagtggatgtgacggaagggcgggctcctgggtctcttcagaacatatcccctgtgcccagggggatcagaggggcagagtccactgcgtgaaagccccactgctatgaccaggtagccgggacgtggggtggatgccagaaaagactccacggaataagagagagcccaggacagcaggcaggctctccgatccccccaggcccttgccccatacacgggctccagaacacacatttggctggaacagcctgagggaccaaaaggccccagtatcccacagagctgaggagccaggccagaaaagtaaccccagagttcgctgtgcaggggagacacagagctctctttatctgtcaggatggcaggaggggacagggtcagggcgctgagggtcagatgtcggtgttgggggccaaggccccgagagatctcaggacaggtggtcaggtgtctaaggtaaaacagctccccgtgcagatcagggcatagtggaaaacaccctgacccctctgcctggcatagaccttcagacacagagcccctgaacaagggcaccccaacacctcatcatatactgaggtcaggggctccccaggtggacaccaggactctgaccccctgcccctcatccaccccgcaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataggttctcaaccctcaccccccaccacgggagactagagctgcaggatcccaggggaggggtctctcctcccaccccaaggcatcaagcccttctccctgcactcaataaaccctcaataaatattctcattgtcaatcagaaatcttgttttatctcattttttcttttctcacatataattcctagcctttcctgggttctcaatttgtggtggaaagaaccctgaacccagtgggaaagttgcctatgtgaaggggttctcagttccctgggcatctctgcaggtaaggccttcctcacccagacaccccttcctcagctctccactgtacccctgagccaccagcctcgcctggctgggaccaggggggtgtcacactctcctagattctgcctttcaacagaaacctaaccacgcatcacacggcacttctcgcatgccttctgtgtctgctccagtctctgggctaaagagttgctggtccgggacaggggataggtccgctcttggtcagatgccaggtccctgccatggcatccctgaccctatgcaacaagccagtgactctggtgagctctctgtgtcaggagaatccatgatccagagtttcatattgtcctgcaagcatctggtgggctgtagctcttgccaaactgggaaataccatggcccagcatcaggatgcaggacagtccggagagggaaatcaggagaagtgaaggggtctctggggagcccagatgtgggctagaggcagaagtaagggtgaagagcacctatgagtcaatgtcatggtctcagcaggaacacagttgaaaatccccattccacacaagaccgtttagcaggaaaggagtccatacttgtgctgccaccaggatgtcctgagaagccttggagaatgaaacatacaggtgcatttcctagacttgacaatgcacgttagccaagtaaaggcaatgaaaagttctctactagggaaataatttcctgtggtaaagcttagcttatgtaaagtcacatttatccatctggcacctctaaaagccccataatattctgcaagatactagtatgtcatggaagtagtttatgaaacataaagtgagatttaagaacaaagatgttacgggtgtatgataagatggctacaggctcagggtcaggctcgaggagtgaaggaggccgtgtcaaattcatgacaagagttggagctgggccaggctgggtcagggctgtgtgaatgcagacagagggctacaggcaaggtcaggcatccatgaacactcagctcccccagaccctcctgcccactgggaccttcgccctcccttggtcacagtggtggagccttcctacccaaacctctatggaggccctggatgactgtgcgttcttagtgcccacgcaaacttagactccctgtctctgcctccagcacatcaggaatgtggcagctgagttcaccagagctgctgggtggtcccgacaggccagggacagagcccgcaaagacaggaagctctgcagtcacaatgaggcagagaaatggccccttggtgcttgatcacagccacccctgatccaaatcccagcctctgaattagaagaaggctaaaaggttctagtggccacagtccctgtctaagcccatttcacaaatgagaaaactaagaccacccaaggagggccagttacgtaggcctgctgggtacaaggccaaggtctacttcacacccagcagctgtccaaagactgagctgtgtcataagtttatattatgaagaactctgaacatataaataaggagacagaaaaataacagtgtcccatgttctcatcacccagcactcaaaataagcaattcacagatgatgccgacccacccacagcaaaataaattctcccttacacaacatttagaaagaaatacaagacatcagatctgttcagctgtaagtactccattactgtcctggaatgacatggaccttaaaataactataatatcactaccaaacctaaatagaaattatcactaattccctaatatcgagaaataagcagggtctcctcaaatgcatcagaaacaccagaagtgctttggcttagttacatgttggtgctgttggtatttgggggtttaagtttatatgaggagcaatatgacatcaaatggtgatgggtgcatgtgccatcaggctggttgtcactggtgaatatttcctcaattgctctagagcctcccggcaaggcaggagctgcaggagctgagagctgtctggagaacttcccctggctgctatacagccacgcctcctggagcaggaacctagggcttccctcagcttttattttcctggaaaatgattctagcatgaaggggattaacttgattcagattggacattgcaaaatagcttgcaaggacagggagctgctaccagcagagtcacccatgtcagactgccactcttgtagtaatgttagctgcataggatggtcaatagctacatccctcagaagggaaggaaggcagagggttgaggcttcagttcacctccttctcatgagtgctgcagagtgtctgtgatgtcagaggtctgcagctgggctctgttcacccaggagtgtgcttcatgctctaggaaggagccactttgcacacagaagatccggggcccagccatccttccagggtgaacaattcatgtcttctctcatggtgaactctaggattcaagccatctaatgcttttgaagccactgtcattatatttaattgatgatgacaggtggccaccaatgatgaatattttcccagggggagtctccccaagtggcttcagacttcctcacatggccccaggggattaaatggctcctgattactcagaggataagaggttctgtcttatcatgttcctttcttatttgtcttatgtgtctttcctgccccaggcctgggatcccccactgatctcccttcccttagtgagaggtgatatttggagaccacattctggaggctccctcatgtcccccatttgaaaaagacaacggcagcctccaccctagctgtcccacccaacatgaggccagattcaggggtgcagggatgctcccaaggttaccctaacagatgtgactggcacttcatattgggaccagccaggcctcactgaccaggcctatccaactagaactactccagaaggtggggctgaaacccaccaaggttcccagaacactgcactctagggcaatcagcctctgcatgggaggagaggagcaccctctgcaccaccccatggtgttaccaaaagttgaaccatgggttggttcaactttgcagagaagagaccacctatcccatctgtggaaattcactccttagcgacactaatgccctctaataaattcaatcctgggcctgagtgatggttggtgcaaaaaacaaattcaagatcccagtgtcctccagaagcctggatttccagggatcctgctgtgggtcacaggatgtcaccggtcccctctctctgtgggttaagtgtgggggccatgtggactccctcatgagcagatgccaccaggaccactggccccagcttcctccttcacagctgcagtgggggctggggctaggggcatcccagggagggtttttgtatgagcctgtgtcacagtgttgggtgttcggcggagggaccaagctgaccgtcctaggtgagtctcttctcccctctccttccccgctcttgggacaatttctgctgtttttgtttgtttctgtatcttgtctcaacttgtggtcagcctttctccctgcatcccaggcctgagcaaggacctctgccctccctgttcagacccttgcttgcctcagcaggtcactacaaccacttcacctctgaccgcaggggcaggggactagatagaatgacctactgagcctcgtctgtctgtctgtctgtctgtctctctctctctgtttgtctctctgtctgtctgacaggcgcaggctgggtctctaagccttgttctgttctggcctcctcagtctgggttcttgtcggaacagctttgcccttgggttacctgggttccatctcctggggaattgggaacaaggggtctgagggaggcacctcctgggagactttagaaggacccagtgccctcggggctgatgctcgggaatcacagagctgggacccagagccaggatccagacccagaatgaggtaggaggtggaggggctgccctgggcgtctgggggctgccagggactgagccctgagccagcctgagactcaggaaaccccgtcaggagggagaagggagaagcagactctggacaccagaaagccaggggaagggtcacaaaaggagtggatgtgacggaagggcgggctcctgggtctcttcagaacatatcccctgtgcccagggggatcagaggggcagagtccactgcgtgaaagccccactgctatgaccaggtagccgggacgtggggtggatgccagaaaagactccacggaataagagagagcccaggacagcaggcaggctctccgatccccccaggcccttgccccatacacgggctccagaacacacatttggctggaacagcctgagggaccaaaaggccccagcatcccacagagctgaggagccaggccagaaaagtaaccccagagttcgctgtgcaggggagacacagagctctctttatctgtcaggatggcaggaggggacagggtcagggcgctgagggtcagatgtcggtgttgggggccaaggccccgagagatctcaggacaggtggtcaggtgtctaaggtaaaacagctccccgtgcagatcaggacatagtggaaaacaccctgacccctctgcctggcatagaccttcagacacagagcccctgaacaagggcaccccaacacctcatcatatactgaggtcaggggctccccaggtggacaccaggactctgaccccctgcccctcatccaccccgcaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcataggttctcaaccctcaccccccaccacgggagactagagctgcaggatcccaggggaggggtctctcctcccaccccaaggcatcaagcccttctccctgcactcaataaaccctcaataaatattctcattgtcaatcagaaatcttgttttatctcattttttcttttctcacatataattcctagccttccctgggttctcaatttatggtggagggaattctgcacccagtgggaaagtcacccaagggaggaggcttacagcctccccgagtcatctctctggaaggtccttcctcttccagtcaccccttccccaactctccaccatacccctgagcctccagcctggcctcagctcagaccagtcccacaccctcctcaattttacttctcaataaagacctgatcatgtaaaacccagtttccaatgtgtcgtctgtgtctggtcatgtgcctgtgctgaagggtcactgctctgggacaggaggcagtttcaggtgagatcccatgtccccgtcaccccacaccccacccaacctgccaggaaaccgggtgagctccctgtgccagggggaaccatgttccagagcagaaagttgtccctgcagagtggtccctgaaatgcagttcttgcccacctgggaaggatgtggagcctagtgaggacagagtggtggccctgagcagggcatcggggagaaacgaggagtgttccaggaccccctgctttgggctagagacagaaaacccttgagcccaggccaagatcagagcagaaacagggttgaacttccctgtcccatccatgatacccagttaggagaccatttactaggtgccatcaccttacgttacattacaacattacgtgattgtgccatcacccgggagacatgaaaaaggctggaaaatggaacccttcagtgtagtttacactttcacaatgtacgttagctatgaaagatgctgacaagtcctgcagttggaaaacagttcatgttacataaccttgcaagtcaagaattctattcagtgtcccaacccacttagccctagagcgctcttcaagacactggtgttcatgtcactagtgctgggacatgggctgaggctgaggcacacagatgattcgttgtgatcaaatgggtcaggctcagggttaacactggccaggtcagaaagagagcatagggctgagatctcaaccatgaagagtctcgaattctaaagtcaggggacgcagtagagttagattatggttatggctggagccatgatggccagcctgtgtgagggtaggactcaggtggactgggtcaaatgagaaaggcaccatcccaagcatagaatcggcatccattggttgtctgatggaggctgtgtcaaaatcatactcgcccaagaatcagggccaggtcacactaggtcagggcagggtaagtgtgacttaagggctacaggcaggtcaagttttcatgggactcagctaccttagacccctccccaccagggcctactccctccctcaatcatgtggttcagcccctccatgtgcacctacaccctgatgtcagagacacaatcatcccagggtccctgacagcgagtgaggtggccttgggagatgcacttcccagccctcctcatcagtcttgggcactgtcaggccccttcttggtgcctccagcacatcagcggtgtggcaggtgccttcaccagagctgctgggtggccaggccaggcctgagacagagcctgcaagggcagagaactctagggccatagtggggcagagaaggggttcctcttggagcctaatcatagaacccctgcctcaagtcacaacctacaagttagaaggaaacttaagggtcctgattcccaccaccctgtctggccccatttcatagatgtgaacgctgagacccctatagcaaagaggaccgctttgatctccaccttctcaatggccctgctgggtaggatcccctctggatgtcccctggtgctgtcccaagactaatctctctaattactgccttgtaagatattacggaaactgacagcaagaaaataaaaaaacaggaggataatacagctcatgttgacccacccacaatcaagtaacctcttttacacagttgtttgaagcaaattgtagacatcatgtccattagtctaaatattccatttgtgtctctaaaaatatggacccccccaaaaaaactacattcttacaaacctaaatataaatatctaattctttcatatcaaaaaaagaatgtttcccatcaaatacttcacaaatatcctatgcttctttcactagacctgtgtttgtgttgttattctgtggttttccatttcatttctatgaggattcaatatggtttgaaattgtgactggtgactgtgtttttagacctgttctgtctgcaggtatcttcctcattgatttttaatttccttgcaaggcaggagctacaggagctgggggttggtcccaggaccttcccatggtcaggatacagcctgtggcctccccaagctggaaacaagcgctcctctctgcttctgcgtttcctgaaaattggttcttggccagaaaggtttaacaaggctcagtgtgacttttcagcaagaccgcttggctactgggctcccatgtggggtcatctatttgtgacgttagctgggcttcacactttgtatccagtgccattagatggtatatggatgcaaggtgactgcatttcagttcgaccaccttttccttctactgactgtctgtaaaaggtgtgccctcatatgttctttgctcctctgggagtgtgattcttatttcagtaagaaatagcatagacatgttgagtctttcctttcatttagcatcttaataatgatgaccatgttgcctgccatctcgtgaagatgaacaattatttcatggtgagctcaaagttatgttactgtatgtgactcacttgagtccaccatggttctattttattgatgatgacaacgacccaccgtggcccactcagtgcctcttctggtggccccaggatcctcctgaaggaacccaggagacctcgatggctttccactctctgttcacaatctatcctgggcacatctttctcctgccttgtgcctggaattgcccattaaccccaagtggactagtccccataactgggaggtgggatttagtgaccacacttggggtgcttctcacacagcccttttgagtcagacactccagacatacccagaaatgagacaagaccctgaaagggtaacaggggcttgcttccaacttctccctggaggttgaggctggcatttcatactaaaacctagtgagacccatcccaaactaagacaacacaaggaggacggaagtgagacgccctggagttgtggttgtggtcacgttggagcttcccatgactgctgactctggggcaagctgcccctcctctaaggcactcactggggacacctgaggacgcctcctgctcttaccctgtagtcacaccaagagatcagggttacaacaaccctatagagaatccctgtccccttccatgtcacttcactccttcgtgaagcaaatgccctcaaggagctcattcccattcctgggtcacagtcacctggaaaacctgatccagacaccaacctcctcaggcctcgccatttccagacgtcccgttactgcatacgcttggtcgactgtcccatctcagcttgagaagggcaggcaggtgtgtggactctgctgagcaaatgccttccaggggcagtggtctggcttcctgcaccatagcttcaggtgggggatggggagggggagttaggggccccagggaagagtttttgtatgaacctgtgtcaccgcattttgtatttggtggaggaacccagctgatcattttagatgagtctcttcttccctttctttccctgccaagttggtgacaattttattctgatttcgatctttgtctgtgacttgccacagcctgtggtcagggtttcctttgggacctcggtcctgggaggctgatctctctcctccctattcagacccctgtatgcctcagctggtcactgagacaccttcatctcctctgaccccagaggcagggagctccaagacaaggccacactggtgtgtctcatgagtgacttctacccgagagccatgacagtggcctggaagatagatggcatcaccatcacccagggtgtggagaccaccacaccctccaaacagagcaacaagtatgcggccagcagctacctaagactggcacccgacagtggaagtcccacaacctctacagctgccaggtcacgcatgaaaggaacactgtggagaagacagtggcccctgcagaatgttcttaggtccccgaccctcacctacacacgggggcctagagctgcaggatcagggcatgtgtctcccctcccactccaagtcatccagcccttctccctgcacccagtaaccctcaataaatatcctcattgtcaaccagaaatcctgctgtctgtcttcatttcttatctcatatttagtttgcaacctccttaaattctaagcaaggatgaggaaaatccaggtgcccagtttatcgggtgagaagtccatggtggtgccatcaccaggaacttgtggaaaggtctgggaatggaaactcacaggtgaatttcacagattttcacaatacagggtggctaagtaaagacacttacaagtcctgcaatagggaaacaggaagtccagaatcctgctcaccatcccagccaacttagtgagccctaggatgctctgcaagatactggtgttcacgtcgctagctctggaaagtggggtgaggctggggcacacgggtgatcagttatgatcagatgggcttagggtgaggttcaaagttaaccagcacgtggctgagatctcaaccatgaagttcccaattctaaagtcaggctctggggtggagtgagtatgtgcttggtgtgtggctgagcctgtgatggtcagctcgtgtgaggggaggactcctgtggactgagacaaatgagcaaagacaccatcccaggcacagaacgggcatcccatggttgtcggggagagtctgtgtcagagtctcattctggactagagtcaaggctgggtcacgcaaggtcagcacagggtgaacatgacctaggggctatctataggcaaagtcaggctttcacgggatctcaactgccccaaacacccccatcccaccaggccccactccctctgtcactcacgttgttccgtcccctcaccccctgcaccatggtgcaccggcagcctcactcagagacaccctcatcccggggtccctgacagtgggcaatttggtcccttgaaggccttgacaggctcggttaatccatagtgcccgggctgggacccccactgtttctggttcatcagggacatggcagcagctgctgggtggccagccaggacaggaacagagctgcaaggcctgggggctttttccacaatgatacacaaagagaggggcccctttggagctcagtcccagccacccctgccccaaatcacagccgtgagctgaattgaatttcaggtgcccagagtccctcagcctctgtttgacccatttcacagctatgaaaattcaagcccatgggagacactgtcccaagcttcaccctctctataagttgtacatttttatgatgaagatctctgaacacaaaaatagggagacagaagaatagtaatgactccaaggttcccatcagccagtccgcagcatcatccattttcagataatgcggacccacccacagcagaataactaaactactccttcaagcaagggtgtgaagcaaatgctagtcatcacacacacaactggagagaatatcaaggatttcttgacatcaaaaatagttaatgagagtcttatcaaatgtcttgtgaatatcattgtgtctatttttgtcgactttgtggtgctgttgcatatttgtgatttaatttcatttctatgtggattaaatacttgacgttatcattggtgaatgtgtttttagacccattccatctgcaggtgtctcccaaattgctctagctttccctggcaaggcaggagctgcaggagcagagagctggtcccgggacctcccacagtcgggatgcaggcgccacctccctgagcaggaacccagtgcttccctcaacctctcttttcctgaaaaatggttctagcatcaagaggctcaagggggttcaggctggacattggcaaactcgcttcccaggacacgtggctacttccagcaaagccacccatgttgtgttgtcattctttcagtgacattagctgcatttgatgatcaataacttcgcgcctcagatgagaaggaaggcagatggtcaagacttcggtccacctccttctcatgagggcttccagaagggagggcacagcagctgcaccgtgcgctcaggagtgtgcttcatgctttgggaagaagaaaaaatgtacattcttcccttttgttcaccactttgataactgatgatctggtgcccagccatcctccagggcgcacagcacaatgtagtaccggagtgagctctagcgtgtgaggacatctgacatgtgggctccactgcagatatactgaattgcaatgacaatgcggctacaaaacataaacatttacccactgggcgcctcctcaggtggcatctgattttctcccattgccccaggagcttccatggctcctgatttctcggaggatgagaggttctgtctcatcatgtccctttcctgccccaggcctgggatcccgcactgacctcacctcccttagcagaaggtgatatttggagaccacactcgggagctcctttatgtccctcacatttgaataaggcagtggcagccactaccccacctcacccaccaaaatgagaccaggttgaggggtgcaggagatccttccattttaccctggaggatagggctggcatttccagtggggaccagccaggcctcactggccaggcccatcccaactaggacaagcccagggaaggctgggctgaggctcctggagtcacagataggttcatgggaagcttcccaagacaccgcactctagggtaaccagcttcttcctggagggagagggcactctctgcatcaccccagggcgtcaccaagcagtcagtgtcgagtcagctccaccagggagaccatttatccctgaccatgggagttcactcctagtgacacagtgccctccaataaactcatccccatggctgcatgatggttggtgggaaaaccaaatccactgtcctccaggaaccaggatttctagggatcctgctggtcacaggatgtcacctgtccccttctctctgtgggggtgagtgtggcagccgtgtgaactccctcatgagcagatgccaccaggggctgtggcctcagcttcctccatcacagctgcagcgggggttgggggtagaggcgtccagagagggtttttgtatgagcctgtgtcacagcactgggtgtttggtgaggggacggagctgaccgtcctagatgagtcttttccccctccttccctggtctccccaaggtactgggaaattttctgctgcttttgttcttttctgtatcttgtgttgacctgtggtgatgctttctctctggagcctaggccctggtcaaggacctctcccctccctgtttagacccttacctcagtgggtcaccaagaccccttcacctctgacctcagatgtagggcactagactggatgacctactgagactcatctgtctgtctgtctgccagagccaggctgcttccctaaaacttgctcagttctgtcctcccccacctgggcttctgtctaacgaactttgtgcaagggaaactgaggccccatctcatgagggagagggaacaaggggctcgaaggagtgaccacctggtggactttagaaggacctgaaaccctcagagccaagataggggaatgaaaactcagagtctcagggcccagtcccctggactgtgggactctggatccaggctgggaacaaggtaggaggtgcaggggcctctccaggtttctgtgggctcccagggagagagccctgagctggtctgggacccatgaagccctgtcaggagggacgggaaggctctggacatgaaggagccaggtgaagtgtcacgaaaggccatggcattcagggaggtggctgatgggtctctgtgggaggcacccctagaagcaggaacccctgagttcaccgacaggcatatcccaaggcagaaaaactgtagattggccctaaacacagagagactctaacacagactccacagacaaagagcccaggacagacagacagtgggacttgggtgagcaaaggccctgactccactgcagaagatccaggagagacggatgtgggtacaaacagagttcttacgtgagagacccactctcccccaacccagagcagctgtgtcaggtgagaaaagtttccagagtgaatctaacaagaggctcacagagctcagagaacacagccagagccggatcacgtcaggatgacagggtgaggcagcgccaggcaattgaaggtccactgtctatacaaaagcccaagtccttggaagatttccaaacaggcgatgggcaggggccaagctcagaggttttctgactgacagagttcttttaggaacatgatgtcacacccttctgagacagtgtggaccacatctgagaggtcctgcactggtactggggggcctgaacactcctcatgcactgaggtcaggggctccccaggtggacaccaggactctgacctcctgcccctcatccattctgcaggtccgctcaaggccacccccttggtcactctgttcccgccctcctctgaggagctccaagccaacaaggccatgctggtgtgtctcataaatgacttctacccaggagccatagaaggaaaatggcaccctagtcaccaagggcatagagacaaccacaccctccacacagagcaacaacaactatgcggccagcagctacctgagcctgacgcccgagcagtggaagtcccacagaagctacagctgccaggtcacgcacaaagaaagtaccatggagaagacaatggcccatgcagaatgttcttaggcccccgaccctcaccccacccacaggggcctggagctgcaggatcccagggcagaggtgttccctcccaccccaagtcatccagtccttctgccgacacccaataaaccctcaataaatgtcctccttgtcaatcagaaaacatgctgtctgctcatttttgtttatccactttccatcctaaatttttttatctccaaagatcaacagaatcctttggacttgtgacaatgcagcctgggaccatcttcgtgtttctctgagccgtactttttccatcaccttatccccatagaatgttccagaacaaggaaatagtcttcagaaggaaccagacatcttcattcttacccacgtctctgttgtgcttcctgctgccctgtgagcacgtccacctctggctgcccggggacacaccctccttacatccctatggccccgggagaacatctcagctcccttctttgttgtcctcggccctcactgtccagatgccatccctctctcaaggtgtttgtccatccccctccaaggccatgtggtcaccccacctgtatttcccctcatcaaagcctagagcatctccccttctccatgggcacactctgttcccgtcatcccagggaccctgccctcagcccccacaggccctccctataataatcactgatgggatgcttaccccctggaccctggtcactcaccccacatccccctctgggtgcctctcatcccacatgtgtcaccggatgccccagctgtattcaacattcctaggggacaagggtcggctctgctcctcactgacaccattatgaatgcctaatgtcctgctgtgcacaagttgtcaattgactggtgagttcaaagtcagattctggggttatgccaggagcttgggtgacgctgattcttcttctgaagaactcagcatgggatctgagctataatacacacacacgtgtacacacacacaatgcacataaacacacatgtccatgctgggcatccttctgggaggatcaggaaggtagaaggggctgcagtcaggcccaggtcaggacatgagcaaagcaaagctgagacctgctgtctccaggctttgggactagggggtcgcccctggatatgggagggtggggcagggttttctgtccaggccaagagggagacaggagaagatgtggacgggattctgatcagggagcagcaggccacatctcagcagtcaggggaggcgcttgctgtggggaatactgttggggactgcatggtgccaggagtgtgtcccaggtgtgagctcttcaggtgatgggcccagaccaggatgcaggtccaggctgtgtgtgtccaggccccacactgcacatgcccatccactgtgggtgccccccgtgccggtgacactccagagcacaggctgtgtgggtcacccgtgcatgtaggggactgcagagcacacacatgtgggtgtgtgtgtaagccgggggagctgaagtggacagcagagatcccccacacgtagagctcctggaggaaaccacactgccagtgaggcctatgacctcccttgagaagctctcctctgggccattgcagctctaatccagcacacatggcctataggtaggaagctgtccccatgggttcaggaggcggacttgggcagtgatctgtgagctgctccttcaggacagctgggccaaggatgctggagctcagaccttgcagtggggtctgtgtccctgtggtcaacgtcattcttcccacaacccccaattcccattccaagcccatcccatcataacctccagtgctgaggatgtggggggcatcaaggaccctccccaccattcccaacttctcaaagaggtcccagctgcaccatgtcagtggcgtcacccagccgctcacctccccttcctccctggcattcctgacaccagctgatccaggccacccaactcctcagaaatgcaattacctgggagacaattccacacacagacctgtcaacccttcccatgactgaggtggatgaacccctaagcccccaaggaagtgatattcaggtcagtagaaggtgacccccttcaccccacctatggctcacccacccatgagaaaagggggctggaccctgggccttgtgagcagctgcagggggttggggggcggggtggcctgggtcgggtgtatcaggagggtttgtgtgcagggttatatcacagtgtaatgtgttcggcagtggcaccaaggtgaccgtcctcggtgagtccccttttctattcttttgggtctagggtgagatctggggagacttttctgtcctttctgttctctctagggtagaggtctcaatctctctggggtctgccaccattgccttttttcctggccccaatttcctccagcctgtcccttcttaggcacctggtggggcatgatgggaagatcccagtgacctcttaatgctccctgctcaggcctgaacctgccgctgtcactcagggggcattctcccctgggctctgggatgttctgctccctcgcacagagtctccagtccccaaagaccagcagagcaggggctcaggctggggcaccagggccatgggacaggggaaggatgctggaaaaagttcagcttcccagggttctgggtcccaactatggggctgctttaaacaccaagaagggaggcctttgactggggacttggggaaatgaagggggacaaggatggaggaagaatgtcctgtgaggtggcgccagggtgctgggtccctcctcctcccccgggacaggcaggctgccatagacagggtggttctcaggacactcagtccaaggttagagcctccccatcccacccaaaaagagagacccccaaagcagatgctgagggaggcactcctggtgggcgcaggtgacagggacctgtcaggacagacatttgtcctaggacagccagatctcccaacgacagggagaccccatagagcagacacagcgccaggctcagaacagaaaatatacctcacatgcaagccctccatctcctggactcccaggacccggctcccaggactgacatcccctccccaccaaggggcctctgtgggaaagtggggcagagactgcaatgatggtgctgggggatatgtgaggaagaaattcacttgtcaaaagggaggagaacctaaaaacaggacacagatgccctcgtgaacagacccagaggagggacctggcaggggatgttcagacagagacgtcccccaaggaaagacgagggcccagggctgaacccagccagcgtcggggagcataggtgaggtgagagctggctgataaggaggggagaatctggagaggaggctggagcagaagaggcctgattctcctcagtcctcagatgctgaggagtttcccatcaggaggtaagcgtccccgccaccgccaagttgacctcagtacagcaagggcccagcctgaggtccctatcctgggccttagtccttcacccacctgaaaactgaggccaggggctccccaggtggacaccaggactctgaccccctgcccctcatccaccccgcaggtcagcccaaggctgccccctcggtcactctgttcccgccctcctctgaggagcttcaagccaacaaggccacactggtgtgcctgatcagtgacttctacccgggagctgtgaaagtggcctggaaggcagatggcagccccgtcaacgcgggagtggagaccaccacaccctccaaacagagcaacaacaagtacgcggccagcagctagctacctgagcctgacgcctgagcagtggaagtcccacagaagctacagttgccaggtcacgcatgaagggagcaccgtggagaagacagtggcccctgcagaatgctcttaggcccccgaccctcaccccacccacaggggcctggagctgcaggttcccaggggagggggtctctctccccatcccaagtcatccagcccttcttcctacactcaataaaccctcaataaatatcctcagtccaccagaaaccctgggttttgtgttttgcttctgtttatacattttctaccctaaattggtccaacctgcaagatgaacaaaattcttttagccttgtgggaatgaagtctggattgtttttgaggggtagttccaccatcacctagaaaggcccagagaatattccagaacagagccttgggcagcaggccccaggactgcccctttcccatacgtgctgtgtttgtgtggacatgtccacctccagcggcctggggcgaccgctccttggttccccatggcccagaagaacgagtaccctccacggatcatcaggcctcacccctggacagcctccctctctcaaggggtccctccttctgaggcggaaggagcctctccagtccatgggcccttggtctcccctactccttaggggcccaccctgttcctgactcccaggaccctgccctctacccccacatctatctctgaagcaggcacagactggaccctgaccctctggacccaggtcactcaccccacaggccagctgggtacccctggtcccacatgtgtcaccagtgtcccagttatactcaagtcccctgggggataagggtcaactctactctctctcacccctaagtaaccagcccaaaactgaccacacctcaagtacctaatgtccagttatccacggatggtcagtggggctggggaggtcaaagtcaatcatgagattccagagtggtgccatagacgtgcctgtaaaccaattggtctttttaagagctgtatgtgggatctaagaaccgggttgatgattgtcccaggaggtagcacaggatggggggcctgggctatgagacaaacacacatacatacatgttcacaaacataaacacacatgaacacctcataggcacacaggtattcacaaacaaacatgcctgcatgcaaatacatacacacacactctcctgtgctatttagaatcattaccacatgggcatcccactaggggctgtgctgggcatccaggaccctcccagggaactcggatctccataggggaccagctccaccttccctgtggcataaacaggcttctcacttcttccatggtgacagtctccaaaggagctgagccgggacacatggcttcctccaggacagagagtagcaggggacccagatgtgatgtgcagacatgcctcctccctctcccctctccctctgggggtgaagggatccctgacttccagtaaagtgtgcatccatgcatggaggggccatccccctcaccctcctatcggccagacctgcttcatgacagggccactggacctgggcgcccaagctgctgcagcggggaacgggtcgggtgtgtcaggaggggtttgtgtgtggggctgtgtcactgtgtgctgtgttcggaggaggcacccagctgaccgccctcggtaagtctccccgcttctctcctctttgagatcccaagttaaacacggggagtttttccctttcctgtctgtcgaaggctaaggtctaagcctgtctggatgtctggaatctttgcccctccttgcctgggctcctgccctcttctgtgattctgtcctctgtgggtcccagttacggggctgcattaaacacagtgacaggaggcctttgactgaggacttggagagatgggggaggaaatggcaggaggacaaagatagaggaagaatattccgtgagaaggtggccccacagcgctgggtcacacgccatcccccaagacaggcaggacaccacagacagggtggtgggtctcagaaaactcaggccctaaacgtggatgcttaccaattcctccactggaggaagacctcagagcagatgcccaggacagggacttctggtagggacggtgactgggacgggtgcctgtttgtcagggaaaacccactggagagtcagatcccccagataacttctcacgacatggagactctttcgaacagacaaagctccacgttcagctcagggagtaaaaaaaaaatgcctcaaatggaggcctttgatctactggaatccagcccccaggactgacaccctgtctcaccaggcagcccagaggggtctctgcagggaggtggggtgggggctgcaatgatggcaccagggagatgtgtgggtaagaaacccactccctgtgagagagaagagcctgaacccaggaccaacagctgccctgcatgaagagatgagaacaaggggaactggtaggaggtgttcagacagacacccccaagatagacaaatacccagggtgagatgtggtcctggactccatcccatccagtgtggagccagcaccggtgggggtctataggtgatggaaaatatgaaaaagagacagatccaagagggggtctgtgacccccaagagtgggggcaactcccatctgacagcgagtgtctccactcaccgctgacctgacctcagtccagcaagggtccggcctgaggtccctgccctgggccttagtcccatacccacttcaagactgaggtcaggggctccccaggtggacaccaggactctgaccccctgcccctcatccaccccgcaggtcagcccaaggctgccccctcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctcttaggcccccgaccctcaccccacccacaggggcctggagctgcaggttcccaggggaggggtctctgcccccatcccaagtcatccagcccttctcaataaatatcctcatcgtcaacgagaaatcctgctccctctcttcttttcttatctcacacataatttgaggcctcccctgggttctcagtgttgggtgggggaatcctggcacccagtgagaaagtggccctgagggagaggctcatagcctcccggggtgtctcctggtgaaagaggcccggataggagaagtctgatcactgaacaccagtccctctgccctttcattcctcccccttctcctcaaagcatagccccccacctccctgcctcctgcctggatggagttgtctctggctgggactccagttacaccctctatctctgccctaacagagacacccttcacccaccatctcttttcccagcctgaaaaccctgctccaagcctggagcctctttgcccctggcccttgcccccggaatgccctcctccctctgtgcccagctcagctcccacccaccctcaccccctccctgtcatccctgagagccagactgtccaggacactccagcaccactgacttctcaagctgttcaatgagggacccacctcgattcctcacctgacagcaggttcagacacttaagaggaatgggaggaagccaggaaggagactcacacgaaaggcctacaggaggctcgggacacttggaaaagataggctctgagctccctaggaaccagtgcaaggagggtaataagcacttcaccacttctgtaaatttaaacaaaccctttgctgaagggaaggtggtgttctcaatgctggggccagtcatctcgtcacaactaaaagtgggaacatgttctatccaaggcctcagtagtaatgggatgtgaaccttgacacacgcacaggtaactatctggcagcccttagacatggtgattctctcaagtgcgtgaacagaaagtcactggccgtctttgggaacatcatttttgggaacacttctccattggatcccgggccttcactggaaaaccaggtccctcatcaggactttctctgtgaggttccctgagtctggggctccaactgctctctgagaggaaggggtgggggaagagaacacgacccagccccacccagcccctcctgcatggcccctcctctgtagagtgggggcacctgcaggggtcaggcctgggttactgtgggtggggcctgggaggggcccttgtggcatcctggggagtctctcccacggctccttgtttgactttcctgtggctgctggctgttatcacaaatgacccctaatttagtgccttaaaacatcacacactgattctctcccaggtctggaggtcagaagtccaaaatgagtccttgggggctaaaatcagggtcccagcagggccggctccttctggggactctggggagaattcgtttccaggacttttccagcttctagaggacaacctcagctcctggccccttcctccaacttcagagcctgagctcagcatcttcaaatctctctcttgctcttctctccctccctaccttcttctctccctctcttccttctctctctctccgtctccctccatccccacatcttgtcctctcactctgaccctcctgcctccctctttcttctataaagaccccagcttggacccacctggataacccaggagcatttcccacctcaggctcctaattgacatgacatctgcaaagtccctgtggccacacatgacacatagacaggtccaggattgggacacgactgtccccgcggggcctaatttagccgaccacagcccctttcccgagttcctctccctttctccatgccctgcccagtccaggctgagccactcctggggggccgtcccagcccagcccaagccctccctatccctggtctcttgtggccccttctcctcctggggttccaggaaggcactgggagtttagccacagctctagggcactgtcttccagcaggccccctgagactaaatgccctccaggccaaatcacccttggaggaagatcctattgtgatcctcactctaggatggtgacatcacagcccagagagcctgagtgacctgccacaggtcacagtagggactcaaacctggtccacccaactgcagatctcagctctggaccccaggtgcctggctgccctcagcccacctggccacgcccacccacttcatccagcttcctccctggagagctcaaagcccactggacccaggcccccatcccgggacccgggattcaagtgacagaattattggaccaacaagggatggaaggggacggggcctcaggttggagtagccagattcctcatgccccttctccttcctccgggtcaaatatcagggtcagggcactcggagggagggaccatgagagtccccttttcctagagaccccatctcagtcctggttctggatccagggcttacggtgtcccccacctccaggagagtcagtccctggcaggtggctccccaagcccaatcccctccattcctggtcccagttgctccctcaacatccaaaaattcctgacatcttcagtcagggactgctctcccaagggaagagcacatggggctctgggtctggggctgtgggaaagaggaaccccggtcctctcggggcccagcaccgagcgcagtaggtgttcgaggggggctgagtggtgacatgtgagactctttgtagaaccccagattcaggttcgtgtacctgatatgcagcggaggtcaaaaactgacacaagtgcttggagatagaaaaagatttatttcatttggctaaagtaagaagacaagaaagcaaattcctccactccatgttaacaaaaggatgaagcagggagtttttatgtggctaaggagtgagggaggtggcatttcaggggaaaagtctgtgtttattcagtctcaggtaacatcttaagcaactagacttgcgggcgacagcggctggtctctacgtccctaaaggcattcactcctgcaaaatacttttgtgactctgaagttatctcctccttcttgacaaagaaacaggacatctgcagcttatgatcacattgtgtgaacaagggatgctgggcaaaaagcaagcagttaacttgtacaagcaggcaagggccaaatcagaattttctttacttcagtcacaaaaatgctgggtactgaaatctcaactcacctggtgtcactcccagggcacaggctaggacaacacgcacccgtccctggagaactctgggctggttcccccttctccccctgctgaccccctcttagtctacctccgctcctcccttcccccaccggagaacctcccagggtttccatttcctcccggataacataacacgtgctgccctgtgaggaggtgctaaagtcaagagcaaggtggcagggggctttcgagcaagaggcgacctgacttcagagaccctcagtccccaagacagacgcatgccctttgagagagcggccgccccaggcacacgcaggctctgggctgtcaggatgggagcacgtggtcctcttccacccacctcccgaatctcccctgctccccgcacccatttccctgtggcccccatttccctgtggtcactgtaatcggaccccactccagtccccttccccactgactctgggagctggggttgatgctggggctggagcagtgaccagcccatggtgaccccggccccatccaggtactaggccactggccaccaatcaactatggtttcccaagcacccatatgtgcccagcctgggcttgggacccaggcctagtcctgcctggcccactgcagcagtaatggtgggctcttcctggagagaacctggaccacagtctctctgcctcaacatctcagtatgaagggccagagaccctcctgatggtcaccttaggagcacaaatgtggtcctgccaggaagaagtaataaaatgtgaatgctgccttcctctggctgcccctccctctctcctgccttttacaagtggtaatcaagggctcctggcctccacggtcccctcccttcctgcctcaagcccagcagtctcaccaccaccccatcacagccccagtggcctgcacgtggctcaatccaatggtcccctcactgtcctccttctgttgacctcaggatgggcttggcaactcacatcattctcgtcatcttgaagcccctcacccacccacccccacccccccgcccccccgccaaggtcctctcttctatggtcccctcccactttgttctgctgctgccccatcagggccaccggcagctagcacccttggtgactctttctttcactgtgtgattcatgaactaccggaatgtaaaagggttccttgctccttccccggccccagccctcagcccagtggtgcctcaggcttgatggctgcccagggctgctgaccacgctctcctggtgccgccctgcccagcaccgatctgggacaccacgggagcctggaagcaggggctgcacccctcacgtcctccgatgttcagccaggtgctgggctgggtatcactgagcccctcgatggccactgctcgacagtggaactgctcccggctctgctgaagatgctacctcacctgccacctggcccagggccacttccagggaaaccctgcactggcgtctgtcctctctatgtcatgggatcccaaaccaccccaggaggcacgtgtccatgtcccgcacaccttacagatgaggagacggagattcggagaccagcagcctgcccgagtcccacagctgcccagggctgcacagatggtgggcactgggactctgatccaaggtcaacccagagccagccccttccctaaggcgtgcagaggaggctgagcctgcccaggtcctgcaggtgttcagggcagcacagtggttgcccaggcccctgacctaggccacccttccatcctgaggccgtgcctgggcaaggccaagagatggtgctgagtgcatgaacccccttgtggctctgtgggatgggcagacctgggctcctcattctctgttgactcagtgggtgaaagaggcaggcaggagggcagccatgggggtgccctctgagtctacaaagcagagccaggacaggtgttcatgtgcccatttcacagatgagaggactgaggctccgatgggaggggtgatgacccacctagggtcacacagtaggttaccggctgacccatgcccgcctcttttcatgactcctcggccctaagggcttttcattcattcattcatccattcatttgttcagactcactcattcattcattcaacaaactctcagctgtgggccaggggctggtgtatgcagcccaggaccacctgccctagaggagctcacaagcttggagaacgacatggagacaccactgcccccaccctgtcaagtctccaaggttggcactctgcccagggagtgtctggggcagcaggagcatctccccacactcaggaaaagatttaactgaaagaaccatctgagagagccccagctgtgatccttgggccacagtgggaacatcacagtccctcactgaccctcacagtgaccctgaggcctaaagctgccattgcccacctcacagaggggacgtgaaccatgatggatgcaccagcgctgcccaggctccacccagttcaggagtagccgagttgggccttagcccacgcctgtcttcacatgccactgtgtctagctcagaccggggccagcccctcacgagtgatggcctcatgacaccgaaggagggttggtctgtgctgggggaacccctcaaggtatagggaagagtgtcacagtgggggatggggtgagaggaactcgtcctggccctggccctgcttagctgcagcctgggctgagggaggtgttctgagtcagatcagggaggggccctgtggcttcctctacagcaaagccagagcccagaatagcctgggagggggtgcaggggccctgctggaggagaggggggtggctgctcagggccctgcgggaggaaaagactgggagctactatgaactgagtgggtgactctcccatcaggcccagcctcctgtggggcctgcaaagccaccaagagagtgtccccagccaggcctggacaaaggcaccattacccttcaacccccatattcactgaatccaggggcaagaagggggacatcgacactcacctgggaacaagcaaaccagctcagatgccccataacgaggccaccagatcccaggcaagcccccattcctcaacacaaaggtccaaaatcaagtttccagccaactagaacatgcgaattttggggacatagaggaaataatcaccatccactcgcaatgcccactgctaatgacacagcacaatgctgaggatgttgctcctccctcccgacatgtcatcctcttctccagagtctctgtcacaccagggccaggttctggattccccacccaccccgcctgcaggacacgagtccttgatgttgaccccacaccctgggctccatccctgacctaaggaccagcttctacggccctgaaagagtcgtgtgtcatgacttgacactggtcctcttccctgtgctgaatgagacgtgaaggaaaaatgaacccaaatctgcccaggatcccctgcgccacacgtgagatgctccagttccctcggggattcagaagcatccctagctggcatcaacggaggccgggaagactaggtcttttcccaaaatgcttagttatgcaaacacctcaaaaggcacccgtacctcttgtaacaacccaagcgtgaggactccctctttctggggtgatctggggaaactgctctcctacatggtcatcttgaggattgcagatgggccacggaaatgtcaacacagtgacatcagcaggggcagtagggtcaggatcagggtcagtctttgtcacttggtcacttgggaccacatcaaacctgaccctgtttggccagtaatttcacaagggtggtctccccaggaaacacgtgggctgggcaaggtctgaggggagggggatgacctgcatcctgcattttccaggacattcccagtttgtgccactgactctggaagctgaggtggatgctagagcagtgtccagcccctggtgaccctagccccatccaggtccccagaccactggccaccaatcagctgcagtttcccaggtgcctatgtgtacccagcctcagctcgggacccaggcctggccgtgcctggcccattgtagcagtaatggtgggctctgcccagagacccaggcctgggctgcctccaggacccccacccacatctatcagagagactcgtgaagttattaatagtgccccttccactcccaggaacatcccagtttaaacaacaaactttggttgcccaagctcagagtaaccgtttgctaaatgactgaatgacgttcttcataatggctaataatgagggggaggaagccaagcccagccacctagcactatggtaagcagtgctggacattacaatgggggccaggggccaggagagcctcactaggggccacatccaggcagtcaccatgacattcctggtcccctgcctggagcccctagaaatgagctcactcaggcccagctcacaacacaaccaggggtggccctaataccatctcccactcagcaacagcacaccacgtccagagaccggcaagggacagctcctctgggcagccctagttcctggggagaccacaggcagcagggagaatgcctcctggctttgggacaggagccagggaggggctgggtgacttctgtggctggcaacacagagcccccgtgtcagctccaggaaagagtagcccacagccaggacgacccaccagggcacccgcagtgtgcctctttccatacaggccatccttcatggtgactctctcttcctatagcaacaccaacacccttgatctggccacgggtccctcctgcttctcacatcaggtctgatgtccactgagcatccaatgtgccagttgccgtgccaggcaccaaagcctggacccctcacaggtgtcactaggatgggccctccctgcccacccagttcccagcctgtgcagggacatgttgggactttctgactatggaaatgatagaggagaaaggggcctcatcttcacagtttcaggccaaaggggagcctcccactcagacccctagacacatcctctcctgacctgtctggggaggaggatgggaagtggtggtcagacttggcctgggctcccacaggggacagaaagtttgcaaaggtctgggcagcagagagcagctcccagaaggaaggggtgctggtccccaggggctgctgggcagagtagctgaagaaggtgagaccccagaccggccaggtaagtaagcccccttctcaggggctgcccagagcgaagtcacatgttcagctctcttctgaggacctgctgctcctggaaacccagcagggttaaggcaggcacagccaggttcagacagctcatgtttgcgggagagggaaatcaagtcaacagacaaggaacaatgtcatgtaggaggcgggatttgtgctggggagaaatagggcagaggatggggggtagggagcacctggctggggtctcacggggggcgacgtcccaggggctggaggcagccagcgactgaggagccctgactagcgccaggcccctgtggctggagttagtggctcgagctcagcctcagtttcccctctgtgcagctgggttgataataatggaaactgactctctgggtggggggagggacaatcagatggaaaatagatgttttgtttgtctctgccgttggttgttttcatccttgggctgttccagccccagacagcctcaggccagccccctgcccatgctgggctccccaccggccctggaaccctcaccccagtgcagctggcctggtgaaaccaagagtgcctgaggcccgaaatagctgggaaaccccaccaagcctcagccctggcagcaggtgcctccttctccccagggtgggaggcaggggggcgattcagtttccaaagcttccaccagcccagctggagaatggtcctgtgtccccgcaccaagacacccaagccccgtgcccaggcttgagttagacagggtctggagatcatggtcaatcaatgatcagaagtagcaccttctgctccagaagcttctattcatgcaggccctaccccctcctcacagctccccaggaaccgttctaaatgccaggttcagagctgtgcccaattggggggcacagccagacacttggagctcagaggggcctggggtgggcagggctggccagagctggacatgggaccctgctgatcacactccacctgccgcccccaggtcttggacccttcaagggagctgggccaagtaaggggatgggaagggaaacaagaacccttccaagagcttccctgggagcccagagcctgaggcagtaacgaagctcctggaagcacagctgccaagaggacttccggggtccctacccagtgggcaggacctcagactggtcagtcacttatttgtgtgtctgtccatccatatatctgaacatgcacacacacacacacgcacacacacacacacactcatccttccacaagccccgaggcctggcctgtgcagggctcttgacacatggtgtcccaggcaaggcaggactgccccagcccacccccaggtgagacctggagtgtgccttctcatgggaggagggggctgtggccttggggtgccccattccctgtccagtcttccccatgctgggtctagatgctgaggtcaaagagaggttgacaggtgtgaggaacaggccactgtggtgaggcttaatgccccctgtccgatgaccagatcctacccactgcccccgttacagacctccctgtctttctccatgtggaggaaacgttcccaggatattccagggctccaggttctgatgagagtatgggaggagaccaagtacccagcctcagggcctgggttcacccctgcagacggcaaatcccatccacctgtgggacttcaccagctcattcttagaggacaccagcctggagctcccttggcccaggaaagccaggagccaggcccgccacacgtagccattgcacatgtcacctgacacataagatgcgaactgtagggtgggcaggccagggatgagtgcccccacctctgccttcctccccacaggcccacccacgaggctgaacagggtggccctagacccagcaccatcttcaatcagctcatccactggcatcccccaccaccgtcccctcaacatgcacaggatgccagccacccaggccagttcctgaagtaaagcaagcaagggggggtacttgtccccgcccagcccagagctcagattgcagatgagacccccttgcttgaagaagacaaggggcaggagatactggggattccatgtggtcatcaaaggtagcctggtggcagcagcaacctcaaacaggcctaggagctggatcaaggactgaagggcagagagaggacgggtgtgttagggggtgagtgtgagcaaaggtataggagtgaccacagcatcccttcttcccacagggccacagtagtgcacaagggccctcatggaagcaccctgaaagctcacctcaaaggccccatactctgtcccccacgtcacctggcctgccaccctacttaatacccaggaagtccttggagtctgtgccacatggatgggctccaagatggaccaggcttccaggggggcagggaacaagggagaaaagaggtctgggccctgcataggacacaggtagtgaccacccggtggaggagagggaatgagcagaggatgctgggagccaggcccaaggcagggccctgcagggtgcacagttctctgggttggacggtggaccaaggccatgaacattcatgctggtccaggccagtggaccagagtgccccaagccccagagctctgcagaggggcaggggcagggcccagagagagcaaggccgagagtagaggccctaaacctcaggtctgaccagatctgcaactctacaggtagctgcatcctgtgttgagacgctattgagtggccttattgtcccgtaccatttataaaacacgtggacacatgttatccacctgagccactcagggattctgtgaggccacagccagaatcatggtcccatttcacaggtaggaaaactgaggcccagagcagttagatcccaaaaagccagagccagctctgtggtgtcctgacttccagcccagggcctcccatctgacaaatggagaaacagaccaggagagaaagggatctgcccgagctcacataggcgcccctgtgtggaggggcccatgtagaggggcccatgtggaggggacctgtatggagggtggcatgtggaggggcccacgtgtggaggggcccatgtgtggaggggcccgtgtggagggatcgtgtgtggaggggcccgtgtggagggatcatgtgtggaggggcccatgtggaggggcctgtgtggagaaatcatgtgtggaggggcccatgtggaggggcctgcgtggaggggcccgcgtggaggggcccgcgtggaggggcccgcgtggagggatcatgtgtgaaggggcccgcatggaggggcctgtcggtagggtgccaggtagaggggcccatgtggaggggatctgttggagggtgtctgtgtggagggggcctgtgtggaggggcccgtgaggagggcgctgtgtggtgggacccgtgtggaggagcctgcatggagaagacctgtatggagggtggctgtgtggaccactgccctctgccagagaccagattgttcacttcctccaccattccacagctccagccccatttcaggggtgcagaaaagaggcctgaaagcagcatggatgagagttagggctacaggccctgatggccattccttccctgtgccttgggagatgcaaggaaggagggtggctgcaaaggcctgtgggagcccagagcactgttcttcccaaaggggcatctgccctgggagcccagacctcagtgtcagacagagaaggggtccccccaccatgctcagccctcatcaacccttgaccttgagcaatctgcttctcttctgtagccctcagtttcctcatctgcccaagggggtgataagagtccctccccacaaggtaggtttgcggattgagatgatgcctaagctgtgcctggcctatggggaccctcacctaccctcagtcattgctcttgcctgggcctgcgggtgacactgtgtgaacctgggcaaatgcctttgccttcctgggcccagccttccctctggtcaaggaggaactgggtcagggaccccgagtgccagccattcaggaaaccagcagattcctgggtgaaggggttggccagggaggcctgagatgggagtagggtgggggccaggccaagggatggggttgggggatgcgctttcccagctctggtggccctgcctgcagctggccacccctggaaatccccaggctaaatttaaccccaagttggctgaaaccagaactcagagtgacaaaaggagaaaaataagaggaagagaaactgagctcatggccacccgggcatgggatgagtgacaaacaggcccaggtgtggcccaggaggagcatggggcagtttcagggctgctgctggatgtttgtgcagctcacaggtgggggcagtagagcctgcgccccaccccaccccctcctagtccagcccctgggcctgatgctgccccctggctgcctccccacaccctgagctccatcctgggtcccagggtccaccagaaggcatctcagaaccagccagcagtggccctgattgtcagcaggaccccagggaggggggtggccaggacagggctctgaagcccccaccccaggaccttccctgggcagaacgagttggtgagggagtgatgagcaaccacaggcctcctaacttcccaagctggcgattctgagaggcctcaaggctgagacacggttcagccttttaggccctcctgaacgtgtcccctgtctccacagcctgggaatgcactctcttttgacccagaaatcctgctcataagaatttatcatggagatgccagagggccagtgcatgtggatgttagccagggagctaagagcaaaacgtgacagaaaagagcccgagagcagatgccagcctcacatccacatccccagatggccttggagaagggtcatagacagatgttcacaacagggcaagaagaagtgaggaaagaagttcccatctttgtgataaccccatgatttcatgcagaaaaagatctggaaggcgccataccaacgcgctaacagggcctcttgggcagtgcaggatcagagacttgctttgtattcttatttaatttttcctgttttcagattttataatcggagaacaaaacattaaaccaatttaagatgtaagatcctataaaaatgctgtattcgatgatgcgaatggcatctgaaaagccttgaacatattatcccaaagaggccaccagataagacgtgacctgtgtgtgcatgaatccctgcatttttatccatacctagatgcacatccgtatccacatctattccccggggctaccggttgcgggggtaaactgtaggtaatattggttttcattttgtacatctaacttttttcattttttgacaatcattatacatttattattatgaaaaatagaaggttttgtcacttaaatcaacatgtttattccaattcacttaacattcagcaaatatttcttgtgtgtctgctacacccacaacagtcagggtgcagggtttgagattacactgatgagaagacagagtgttctctcttgaggagtagtacaatgggggattatatggaagaggtcactacgatcctaacatggattcgcatcctgtatgtcttaggtgctgcccaaagcccgaaattgtctcacagctccagccagctcagaggcaggaagcccagggaaagttgccgagtcataaaaatggaaagagagggcattccaggggggatgagtacctagcagccgacatttagcaaagaggattggaaaatgaacccccccttaaaatacagttaaacacagaggagggagcaactgcaaacaaaaagtttaagcgatttctgcaaagagcaataaaagccatagagcagcttgggacaaggtcaggtcaggatgagcagaagttgggaaggaaagaaggaagccaggatggacttggagagtttttaccagttcctcaggcaggaagaattgtatggtaggtcagagcatatttctaggaagacctcggttgacaaatttctctgccactgagagatgacaatttaccttggtaactaatctctctcctcatgttcccatctatttgatattgatttaatatgagtagctacctcccatgtgtataataggaaatgtatgggagaatgcatattaattcctgaatagaatatctggttccatgaatgatggaagttggttagaatttattattggaaactcaccctgcactacctatagttggtttattttaattatacttatattcattatatagtaactcatatatatttgtcatttcttttcttatattcaaaaagtctctacataaataaactctgcacctatggtcattgctgggtatctgttctatacacagcaaggagccagacgccctatcttacttgttcactttccagcttctccttagaaaaaaaaatacaagtttttaacccaattctatgagtctagtactgtgacccaaaacccaaagggcaggaactcaacagccacctctccatcctgcctgcctcccaacccacattccccttccagaaccctcactgatgagggaaaagatgatgtctccaagaggagcagcccgttcacacatcttcaagcttcatctccccagcagccatccaagtgcctgaccttcaaggctctcaataaacagtctgaatgaggaaagaaagggagggagggaaagaaggagggagggagaaaggggtaggtggatggatgtatagatgggtgagtgattgatgggtggattggtaggtgaatggatgagtggatagttgggtgggtgagtggatggctggatagatgaatgcgtggactggtgggtacatgtgtgggtgggtagttggatgggtgaatagttggataagtaggtaaattctaaccatgagaagcacagattggtatctggcaactctgtgtagagattagattccaattcctgctctgatcctgactcgggtgtgatcttgggccctttccttaatgtcttgaagccttttcccttcatctgccctgcccatctcacaaactgctgggaagaaccctggaaggacatatgtgcacgaagatgctttagaaaccctagcaagcttctcaggtgtgaccttagcattggagggaacttgaaggtcattgggctgactctcccgatggttggatcacagttcatggtaagagcctaagcttagagtccagacagacctgggtttgtgtcctggctccaccacttgtccgagtgtgactgtcctgcctgtgtactcctctgtgatgtggaggtgatgatggtggcagcttcccctcagggctatgtgaggattcagtgggatcatcgtggaaagccctgggcacatcacccagcaggggtgccacgacgaaacccaaggtctgccctccggggtcccaaaaaagaggcccagtcttgcctttccagagcagggtaccctagaggccatgggattgaaggagagctctaggatgtccagctcacgggttcacaaaaccctgaaaagtgtctgtataaatgctcattgcagggaaagatctgtggctttatacagaaagaggccatgacacataaagggttaaccacagtccatctaatccaggactctcacttaggaaactgagacctatgtcctgtccaagggcactctgtgggtcaggggacagcaaagcacagacattcaacccagcatggaggcccctccccacccaggagcaggagcctgccttggaatgccagacctgagataggattactgccacctgggaacagcatacactggtgagaggcaggggcagggagaacaccaccacaggggcagggagaacaccaggatggggaaagggaaccacagggcctactcttttaattaagcagtagaattgtaagaaaattgcaactttcttttaaaacctgtctttcaaggttgttaaaatggggttttaataacaaaactgtgggagaaagaggtggctgatgtcaaaaacatctcaacccactcccctgggggacctgcagttctctagttcgtgagtttctgctaacaaaaagcacactaaaagaggggccaaaacaaatggaaatcaagcttatcaaacacagatgacatggagttgaccaaagcatctagagctgagattccaggaagcagatctctctcctttctctgggaccatcctaggagaggttccagggccccctggcacagaggtgccaccagcgacctcaaacttcaggcgcaggtgggggcaacaggcgtagttgaggctacagggacacaggtgtcagcacagcatacgagagggccaccttgtttgttttctgacttcctcttaaaatacagtttatcgcccttgatctttagtttcaaatagtaactattcacagtaaacaatgtgacacagtaaacaacgtgtacagaaaaacaaacaggagaaaacaatttgccccttgtacttcacccagaagagccactgctaatattttgatgtatttccttctattttagttgcaaactgtaacaaccattaaataaataaatacgatgaatttgtaaagtttacagagtaataataggagtgatgattgcacaacatcgtgaatgtactaaatgccactcaattgtacactttaaaatggtgaattccacatgatgtgagtttcacatctattagcctcctgggctaggaatactgcctagacctcaggaaccacggaattcatcatctctttccttttccttaaagtttgacctcctgtgtgtgcccttcaacaaacggtttttcagcttgtcctgcttttgaacttcatacggattgaagaagaccatgtgtatttttcatggtttgcttctttctcaacactgtctctttgatattgatgttgatgaattactcatttcactgctgactagaagcccactgtgtggaggtcccatcactcagctgtccactctgctgccactgacacatgggcagttttgcccaggagcagggcatcagaaacacccaattggagtccagtgtgacagtttgtccagggcctgtcattgtacaacacatcatttcactttgtttttcaaacatagtgaattctttcctaattaaagaagaaaagagtataaagagaaagtttccagtgcagcctggagatctgtactggttgtatctggaattccagactcagccttgcatttcacatagcagatagatgatgatgatggagaaggagaagaagaaggaggaggaggaggaaagaaggaagaagaagaagaagaggaggaggaagaagaagacgaagggaagaagaagaaggatgaggaggaggaggaatagacagactgacaaagattctctactgttgtcacttaacaacatatccatgcaggtgtggataaacctgggtgcgcatcacactgggaacaagcagctccaacaacactgaggcagcctcttcccaagtcagctggacaattaggctgctttgctcaggtcgttcactgttctgagcaggacacagccaaagcccctcgcccccacctctgtgcaaggatccagtgactgacttggggttgaccctctctgcaaagatcaaaggtcatgcctgtctaaggccttggacgcatgtcccagactgacttccagaaaagagagcctgaactgccctgctgagtgcccaaagaggcccccctgcatccacgaaaggtacccatgagggtgtggaaggagaggcatccacaggaactgggctcccacctgccccacctgaccccagctctacactgagaataggggagatagaggggcccccagggcctcctccaaactccccagagcatccactgtgaggtgacctgaaccaggccccaagctccctcctcagggaggcctcagactcctccacctccgcagcctccaccgtggctgctctgtgtctctctctggcagcaccaaccacccccactgctactgacaccaccattggagaaggctcagggctatgagttcagcctctggctgctctggagatctagggaggcaggagggctgcaagtgggggctgggagagctattccaggtcaggggtctgtgggctggagtctgtgaggtgtgcacatgtggggctgagggatggctggagaggccctgttggtggccactgtctccaccttcagagcccaggaaggagatttggcccctcctgcatcagataatccctagctccttagttcccaagtcttcagtccccagcctggctctcctggggtggctgcccttgctgtgggaggctggggggatcttcagcccagcacctccagcagcagggcctggtgcccccagctctgcactggcccaggtctcagatcctgggctgtcagcccctcatgggtcccaggtgcccagcccagctgccccaggaggcaggggggtctgggggacaccaaaagagtcttagagaatggacctcaccactcagccacacagaaaaactgaggcccagaggggacaaaggacttgtcatgggtccagctgtgagcctggctgccagtcttaaggcccagtgctcccccacaggatgctgtcacacacacttggccctgatgaggtcccctcttagctgggatccagccccatgaccagcaccccgaggctgcaaagggtgctgggctccagcaccccaagactccacattgaccccaagactccacattgaccactctgagcagaggagcccttgggtctttggggaggttagagagctggcacccccaccccagtctacccggccccggggttcctctctggatagggggccccagtgcagttcacacaggccctgcacgtgttccttcctcagggcatgcgtggctgaagcttgctcaacactaaacatcccagcccagtttattgaatgtgagggatacgcagggtctgagcagagcagccatcccctcctgcctcccctccttccagcgctagagccagagtgactccactgtcctgtgcccacccccagaccaaggagcctcaggaccactcttggggcagggagctcgaggctataggaagattgccccagagcaggatggctgagtgttcaggagtccagccatgtggtaaccgtgcactgcagtgtcacctgaacagggatgtcaccacgtgaaggcatcccagctgcatccttggctgacatatcctaactgtgcctgtacaaggggctccacacacacacacatccacacacacacacacacacacagtcacacttacatacccattcatgctcacacatttatccacacacattcatactcattcacacacacacacgcattcacacactcacacccactcacatgcactggccagagccagagtcgatagcgccctctagtggccactgttgtcccttctctagaaggtctctgtcttatcagtcacaacccccaggagtcttcatccggaaatcccaggatgcacaagtctggcaagatc
